US011198709B2

(12) United States Patent
Allen et al.

(10) Patent No.: US 11,198,709 B2
(45) Date of Patent: Dec. 14, 2021

(54) PLANT DERIVED INSECTICIDAL PROTEINS AND METHODS FOR THEIR USE

(71) Applicants: E. I. DU PONT DE NEMOURS AND COMPANY, Wilmington, DE (US); PIONEER HI-BRED INTERNATIONAL, INC., Johnston, IA (US)

(72) Inventors: Stephen M Allen, Wilmington, DE (US); Jennifer Kara Barry, Ames, IA (US); Virginia Crane, Des Moines, IA (US); James J English, San Ramon, CA (US); Kevin A Fengler, Clive, IA (US); Eric Schepers, Port Deposit, MD (US); Ingrid Udranszky, Mountain View, CA (US)

(73) Assignees: E. I. DU PONT DE NEMOURS AND COMPANY; PIONEER HI-BRED INTERNATIONAL, INC.

( * ) Notice: Subject to any disclaimer, the term of this patent is extended or adjusted under 35 U.S.C. 154(b) by 534 days.

(21) Appl. No.: 15/750,520

(22) PCT Filed: Jul. 8, 2016

(86) PCT No.: PCT/US2016/041452
§ 371 (c)(1),
(2) Date: Feb. 6, 2018

(87) PCT Pub. No.: WO2017/023486
PCT Pub. Date: Feb. 9, 2017

(65) Prior Publication Data
US 2018/0222947 A1    Aug. 9, 2018

Related U.S. Application Data

(60) Provisional application No. 62/201,977, filed on Aug. 6, 2015.

(51) Int. Cl.
| | | |
|---|---|---|
| C12N 15/82 | (2006.01) |
| C07K 14/415 | (2006.01) |
| A01N 37/46 | (2006.01) |
| A01N 65/00 | (2009.01) |
| A01N 47/42 | (2006.01) |

(52) U.S. Cl.
CPC ............ *C07K 14/415* (2013.01); *A01N 37/46* (2013.01); *A01N 47/42* (2013.01); *A01N 65/00* (2013.01); *C12N 15/8286* (2013.01); *C07K 2319/00* (2013.01); *Y02A 40/146* (2018.01)

(58) Field of Classification Search
None
See application file for complete search history.

(56) References Cited

U.S. PATENT DOCUMENTS

| | | |
|---|---|---|
| 2013/0333068 A1 | 12/2013 | Coffin |
| 2014/0051829 A1 | 2/2014 | Desai et al. |
| 2014/0274885 A1 | 9/2014 | Cong et al. |
| 2015/0067923 A1 | 3/2015 | Coruzzi et al. |

OTHER PUBLICATIONS

Anderluh et al (2014, MACPF/CDC Proteins—Agents of Defence, Attack and Invasion, Subcellular Biochemistry, 80, Springer).*
Morita-Yamamuro et al (2005, Plant and Cell Physiology, 46(6): 902-912).*
Asada et al. (Plant Biotechnology, 2011, 28: 9-15).*
Morita-Yamamuro, et al.: "The *Arabidopsis* gene CAD1 controls programmed cell death in the plant immune system and encodes a protein containing a MACPF domain," Plant Cell Physiology, Mar. 30, 2005 (Mar. 30, 2005), vol. 46, pp. 902-912, Entire Document.
Noutoshi, et al.: "Loss of Necrotic Spotted Lesions 1 associates with cell death and defense responses in *Arabidopsis thaliana*," Plant Molecular Biology, Aug. 10, 2006 (Aug. 10, 2006), vol. 62, Abstract Only, Entire Document.
International Search Report and Written Opinion, International Application No. PCT/US2016/041452 dated Oct. 19, 2016.

* cited by examiner

*Primary Examiner* — Stephen Uyeno

(57) ABSTRACT

Compositions and methods for controlling pests are provided. The methods involve transforming organisms with a nucleic acid sequence encoding an insecticidal protein. In particular, the nucleic acid sequences are useful for preparing plants and microorganisms that possess insecticidal activity. Thus, transformed bacteria, plants, plant cells, plant tissues and seeds are provided. Compositions are insecticidal nucleic acids and proteins of bacterial species. The sequences find use in the construction of expression vectors for subsequent transformation into organisms of interest including plants, as probes for the isolation of other homologous (or partially homologous) genes. The pesticidal proteins find use in controlling, inhibiting growth or killing Lepidopteran, Coleopteran, Dipteran, Hemipteran, fungi and nematode pest populations and for producing compositions with insecticidal activity.

10 Claims, 23 Drawing Sheets

Specification includes a Sequence Listing.

Fig. 1A

```
                   1                                                50
IPD079Aa    (1)   MAQIEPLPGSDAIGLSYDVFGFYANPKSVNRQLFDFAPQQEITLEDHTWL
IPD079Ab    (1)   MAQIEPLPGSDAIGHSYDVFGFYANPKSVNSQLFDFAPQQEIILEDHKWL
IPD079Ac    (1)   MAQIEPLPGSDAIGHSYDVFGFYANPKSVNSQLFDFAPQQEIILEDHKWL
IPD079Ad    (1)   MARIEPLPGSDAIGHSYDVFGFYANPKSVNTQLFDFAPQQEIILEDHKWL
IPD079Ae    (1)   MARIEPLPGSDAIGHSYDVFGFYANPRSVNTQLFDFAPQQEIILEDHKWL
IPD079Af    (1)   MARIEPLPGSDAIGHSYDVFGFYANPKSVNTQLFDFAPQQEIILEDHKWL
IPD079Ag    (1)   MARIEPLPGSDAIGHSYDVFGFYANPKSVNTQLFDFAPQQEIILEDHKWL
IPD079Ah    (1)   MARIEPLPGSDAIGHSYDVFGFYANPRSVNTQLFDFAPQQEIILEDHKWL
IPD079Ai    (1)   MARIEPLPGSDAIGHSYDVFGFYANPKSVNRQLFDFAPQQEIILEDHKWL
IPD079Aj    (1)   MARIEPLPGSDAIGHSYDVFGFYANPKSVNRQLFDFAPQQEIILEDHKWL
IPD079Ak    (1)   MARIEPLPGSDAIGHSYDVFGFYANPKSVNRQLFDFAPQQEIVLEDHKWL
IPD079Al    (1)   MARIEPLPGSDAIGHSYDVFGFYANPKSVNTQLFDLAPQQEIILEDHKWL
IPD079Am    (1)   MARIEPLPGSDAIGHSYDVFGFYANPKSVNTQLFDFAPQQEIILEDHKWL
IPD079An    (1)   MVRIEPLPGSDAIGHSYDVFGFYANPKSVNTQLFDFAPQEEIILEDHKWL
IPD079Ao    (1)   MARIEPLPGSDAIGHSYDVFGFYANPKSVNTQLFDFAPQQEIILEDHKWL
IPD079Ap    (1)   MARIEPLPGSDAIGHSYDVFGFYANPKSVNTQLFDFAPQQEIILEDHKWL
IPD079Aq    (1)   MARIEPLPGSDAIGHSYDVFGFYANPRSVNTQLFDFAPQQEIILEDHKWL
IPD079Ar    (1)   MARIEPLPGSDAIGHSYDVFGFYANPKSVNTQLFDFAPQQEIILEDHKWL
IPD079As    (1)   MARIEPLPGSDAIGHSYDVFGFYANPRSVNTQLFDFAPQQEIILEDHKWL
IPD079At    (1)   MARIEPLPGSDAIGHSYDVFGFYANPKSVNTQLFDFAPQQEIILEDHKWL
IPD079Au    (1)   MARIEPLPGSDAIGHSYDVFGFYANPKSVNTQLFDFAPQQEIILEDHKWL
IPD079Av    (1)   MARIEPLPGSDAIGHSYDVFGFYANPKSVNTQLFDFAPQQEIILEDHKWL
IPD079Aw    (1)   MARIEPLPGSDAIGHSYDVFGFYANPKSVNTQLFDFAPQQEIILEDHKWL
IPD079Ax    (1)   MARIEPLPGSDAIGHSYDVFGFYANPKSVNTQLFDFAPQQEIILEDHKWL
IPD079Az    (1)   MAQIEPLPGSDAIGHSYDVFGFYANPKSVNRQLFDFAPQQEITLEDHTWL
IPD079Ba    (1)   MARIEPLPGSDAIGHSYDVFGFYANPRSVNTQLFDFAPQQEIILEDHKWL
IPD079Bb    (1)   MARIEPLPGSDAIGHSYDVFGFYANPKSVKKELFDFALQKEITLEGHTWL
IPD079Bc    (1)   MARIEPLPGSDAIGHSYDVFGFYANPKSVKKELFDFALQKEITLEGHTWL
IPD079Bd    (1)   MAQIEPLPGSDAIGHSYDVFGFYANPKSVKRELFDFAPQQEITEEGHTWL
IPD079Be    (1)   MAQIEPLPGSDAIGHSYDVFGFYANPKSVKRELFDFAPQQEITEEGHTWL
IPD079Bf    (1)   MAQIKPLPGSDSVGHNYDVFGFFANPKSVKRQLFDFAPQEEITLEGHTWL
IPD079Bg    (1)   MAQIEPLPGSDAIGHSYDVFGFYANPKSVKRELFDFAPQQEITEEGHTWL
IPD079Bh    (1)   MAQIEPLPGSDAIGHSYDVFGFFASPKSVKRHLFDFAPQEEITLEDHDWL
IPD079Bi    (1)   MVNIEPLPGSDAIGHSYDVFGFYANPKSVKKELFDFAVQKEITSEGHTWL
IPD079Bj    (1)   MVNIEPLPGSDAIGHSYDVFGFYANPKSVKKELFDFAVQKEITSEGHTWL
IPD079Bk    (1)   MVNIEPLPGSDAIGHSYDVFGFYANPKSVKKELFDFAVQKEITSEGHTWL
IPD079Bl    (1)   MVNIEPLPGSDAIGHSYDVFGFYANLKSVKKELFDFAVQKEITSEGHTWL
IPD079Bm    (1)   MVNIEPLPGSDAIGHSYDVFGFYANPKSVKKELFDFAVQKEITSEGHTWL
```

Fig. 1B

```
                    51                                                      100
IPD079Aa    (51)    LSTDIVYIAVRDTDINTVSLRTKDAYSTELAASVKVSGSYGSFSASVESD
IPD079Ab    (51)    LSTDIVYVAVRDTDIKTVSLCTKDEYSTELAASVKISGSYGSFSASVESD
IPD079Ac    (51)    LSTDIVYVAVRDTDIKTVSLCTKDEYSTELAASVKISGSYGSFSASVESD
IPD079Ad    (51)    LSTDIEYIAVRDTEIKTVSLRTKDAYSTELAASVKVSGSYGSFSASVESD
IPD079Ae    (51)    LSTDIEYIAVRETEIKTVSLRTKDAYSTELAASVKVSGSYGSFSASVESD
IPD079Af    (51)    LSTDIEYIAVRDTEIKTVSLRTKDAYSTELAASVKVSGSYGSFSASVESD
IPD079Ag    (51)    LSTDIEYIAVRDTEIKTVSLRTKDAYSTELAASVKVSGSYGSFSASVESD
IPD079Ah    (51)    LSTDIEYIAVRETEIKTVSLRTKDAYSTELAASVKVSGSYGSFSASVESD
IPD079Ai    (51)    LSTDIEYIAVRDTEIKTVSLRTKDAYSTELAASVKVSGSYGSFSASVESD
IPD079Aj    (51)    LSTDIEYIAVRDTEIKTVSLRTKDAYSTELAASVKVSGSYGSFSASVESD
IPD079Ak    (51)    LSTDIEYIAVRDTEIKTVSLRTKDAYSTELAASVKVSGSYGSFSASVESD
IPD079Al    (51)    LSTDIEYIAVRETEIKTVSLRTKDAYSTELAASVKVSGSYGSFSASIESD
IPD079Am    (51)    LSTDIEYIAVRDTEIKTVSLRTKDAYSTELAASVKVSGSYGSFSASVESD
IPD079An    (51)    LSTDIEYIAVRDTEIKTVSLRTKDAYSTELAASVKVSGSYGSFSASVESD
IPD079Ao    (51)    LSTDIEYIAVRDTEIKTVSLRTKDAYSTELAASVKVSGSYGSFSASVESD
IPD079Ap    (51)    LSTDIEYIAVRDTEIKTVSLRTKDAYSTELAASVKVSGSYGSFSASVESD
IPD079Aq    (51)    LSTDIEYIAVRETEIKTVSLRTKDAYSTELAASVKVSGSYGSFSASVESD
IPD079Ar    (51)    LSTDIEYIAVRETEIKTVSLRTKDAYSTELAASVKVSGSYGSFSASVESD
IPD079As    (51)    LSTDIEYIAVRDTEIKTVSLRTKDAYSTELAASVKVSGSYGSFSASVESD
IPD079At    (51)    LSTDIEYIAVRDTEIKTVSLRTKDAYSTELAASVKVSGSYGSFSASVESD
IPD079Au    (51)    LSTDIEYIAVRETEIKTVSLRTKDAYSTELAASVKVSGSYGSFSASVESD
IPD079Av    (51)    LSTDIEYIAVRETEIKTVSLRTKDAYSTELAASVKVSGSYGSFSASVESD
IPD079Aw    (51)    LSTDIEYIAVRDTEIKTVSLRTKDAYSTELAASVKVSGSYGSFSASVESD
IPD079Ax    (51)    LSTDIEYIAVRETEIKTVSLRTKDAYSTELAASVKVSGSYGSFSASVESD
IPD079Az    (51)    LSTDIVYIAVRDTDITTVSLRTKDSYSTELAASVKVSGSYGSFSASVESD
IPD079Ba    (51)    LSTDIEYIAVRETEIKTVSLRTKDAYSTELAASVKVSGSYGSFSASVESD
IPD079Bb    (51)    LSTDIEYIAVRDTEIKTVSLRTKDAYSSELAASVKISGSYGGFSASVESD
IPD079Bc    (51)    LSTDIEYIAVRDTEIKTVSLRTKDAYSSELAASVKISGSYGGFSASVESD
IPD079Bd    (51)    LSTDIVNTAVRDTEIKTVSLRTKDEYSTELAASVKVSGSYGGFSASVESD
IPD079Be    (51)    LSTDIVNTAVRDTEIKTVSLRTKDEYSTELAASVKVSGSYGGFSASVESD
IPD079Bf    (51)    LSTDIEYTIVRDMEIKTLSYRTKDAYSTELAASVKVSGSYGGFSASVESD
IPD079Bg    (51)    LSTDIVNTAVRDTEIKTVSLRTKDEYSTELAASVKVSGSYGGFSASVESD
IPD079Bh    (51)    LSTDIEYTAVRDTDIKTISYRTKDAYSRDLAASVKMSGGYGGFSASVESD
IPD079Bi    (51)    LSTDIKYIAVRDTEIKTFSLRTKDAYSSELAKSVKISGSYGGFSESVESD
IPD079Bj    (51)    LSTDIKYIAVRDTEIKTFSLRTKDAYSSELAKSVKISGSYGGFSESVESD
IPD079Bk    (51)    LSTDIKYIAVRDTEIKTFSLRTKDAYSSELAKSVKISGSYGGFSESVESD
IPD079Bl    (51)    LSTDIKYIAVRDTEIKTFSLRTKDAYSSELAKSVKISGSYGGFSESVESD
IPD079Bm    (51)    LSTDIKYIAVRDTEIKTFSLRTKDAYSSELAKSVKISGSYGGFSESVESD
```

Fig. 1C

```
                       101                                                       150
IPD079Aa     (101)  FSQSISDETDSTYTSVRTNVNKWKLSLKPTVEELRSMLTPSFKEALASMN
IPD079Ab     (101)  FSQSISDDTDSTYTSVRTNVNKWKLSLKPTVEELRSMLTPSFKEALASMN
IPD079Ac     (101)  FSQSISDDTDSTYTSVRTNVNKWKLSLKPTVEELRSMLTPSFKEALASMN
IPD079Ad     (101)  FSQSISDETDSTYTSVRTNVNKWKLSLKPTVEELRSMLTPSFKEALASMD
IPD079Ae     (101)  FSQSISDETDSTYTSVRTNVNKWKLSLKPTVEELRSMLTPSFKEALASMD
IPD079Af     (101)  FSQSISDETDSTYTSVRTNVNKWKLSLKPTVEELRSMLTPSFKEALASMD
IPD079Ag     (101)  FSQSISDETDSTYTSVRTNVNKWKLSLKPTVEELRSMLTPSFKEALASMD
IPD079Ah     (101)  FSQSISDETDSTYTSVRTNVNKWKLSLKPTVEELRSMLTPSFKEALASMD
IPD079Ai     (101)  FSQSISDETDSTYTSVRTNVNKWKLSLKPTVEELRSMLTPSFKQALASMN
IPD079Aj     (101)  FSQSISDETDSTYTSVRTNVNKWKLSLKPTVEELRSMLTPSFKQALASMN
IPD079Ak     (101)  FSQSISDETDSTYTSVRTNVNKWKLSLKPTVEELRSMLTPSFKQALASMN
IPD079Al     (101)  FSQSISDETDSTYTSVRTNVNKWKLSLKPTVEELRSMLTPSFKEALASID
IPD079Am     (101)  FSQSISDETDSTYTSVRTNVNKWKLSLKPTVEELRSMLTPSFKEALASMD
IPD079An     (101)  FSQSISDETDSTYTSVRTNVNKWKLSLKPTVEELRSMLTPSFKEALASMD
IPD079Ao     (101)  FSQSISDETDSTYTSIRTNVNKWKLSLKPTVEELRSMLTPSFKQALASMN
IPD079Ap     (101)  FSQSISDETDSTYTSVRTNVNKWKLSLKPTVEELRSMLTPSFKEALASMD
IPD079Aq     (101)  FSQSISDETDSTYTSVRTNVNKWKLSLKPTVEELRSMLTPSFKEALASMD
IPD079Ar     (101)  FSQSISDETDSTYTSVRTNVNKWKLSLKPTVEELRSMLTPSFKEALASMD
IPD079As     (101)  FSQSISDETDSTYTSIRTNVNKWKLSLKPTVEELRSMLTPSFKQALASMN
IPD079At     (101)  FSQSISDETDSTYTSVRTNVNKWKLSLKPTVEELRSMLTPSFKEALASMD
IPD079Au     (101)  FSQSISDETDSTYTSVRTNVNKWKLSLKPTVEELRSMLTPSFKEALASMD
IPD079Av     (101)  FSQSISDETDSTYTSVRTNVNKWKLSLKPTVEELRSMLTPSFKEALASMD
IPD079Aw     (101)  FSQSISDETDSTYTSIRTNVNKWKLSLKPTVEELRSMLTPSFKEALASMD
IPD079Ax     (101)  FSQSISDETDSTYTSVRTNVNKWKLSLKPTVEELRSMLTPSFKEALASMD
IPD079Az     (101)  FSQSISDETDSTYTSVRTNVNKWKLSLKPTVEELRSMLTPSFKEALASMN
IPD079Ba     (101)  FSQSISDETDSTYTSVRTNVNKWKLSLKPTVEELRSMLTPSFKEALASMD
IPD079Bb     (101)  FSQSISDETDSTYTSVRTNVNKWKLSLKHTVEELRSKLKPALKEALANMK
IPD079Bc     (101)  FSQSIEDETDSTYTSVRTNVNKWKLSLKHTVEELRSKLKPALKEALANMK
IPD079Bd     (101)  FSQSISQETDSTYTSVRTNVTKWKLGLKPTVEELRSMLTPSFKEALASME
IPD079Be     (101)  FSQSISQETDSTYTSVRTNVTKWKLGLKPTVEELRSMLTPSFKEALASME
IPD079Bf     (101)  FSQSISQETDSTYTSVRTNVTKWKLGLKPTVEELRSMLTPSFKEALASME
IPD079Bg     (101)  FSQSISQETDSTYTSVRTNVTKWKLGLKPTVEELRSMLTPSFKEALASME
IPD079Bh     (101)  FSQSISQETDSTYTSVRTNVTKWKLRLKPTVEELRSMLTPSFKEALASMD
IPD079Bi     (101)  FSESISDETDSTYTSVRTNVNKWKISLKHSVEKLRSLLKPALKEPLASMN
IPD079Bj     (101)  FSESISDETDSTYTSVRTNVNKWKISLKHSVEKLRSLLKPALKEPLASMN
IPD079Bk     (101)  FSESISDETDSTYTSVRTNVNKWKISLKHSVEKLRSLLKPALKEPLASMN
IPD079Bl     (101)  FSESISDETDSTYTSVRTNVNKWKISLKHSVEKLRSLLKPALKEPLASMN
IPD079Bm     (101)  FSESISDETDSTYTSVRTNVNKWKISLKHSVEKLRSLLKPALKEPLASMN
```

Fig. 1D

```
                     151                                                  200
IPD079Aa    (151)    SEELFTTYGTHYLNEVLVGGRADYVATTKTSAFSSDTKISVVAESSFKSV
IPD079Ab    (151)    SEELFTTYGTHYLSEVLVGGRADYVATTKTSAFSSDIQISVVAESSFKSV
IPD079Ac    (151)    SEELFTTYGTHYLSEVLVGGRADYVATTKTSAFSSDIQISVVAESSFKSV
IPD079Ad    (151)    SEELFTTYGTHYLSEVLVGGRADYVATTKTSAFSSDIQISVVAECSFKSV
IPD079Ae    (151)    LEELFTTYGTHYLSEVLVGGRADYVATTKTSAFSSEIQISVVAECSFKSV
IPD079Af    (151)    SEELFTTYGTHYLSEVLVGGRADYVATTKTSAFSSDIQISVGAECSFKSV
IPD079Ag    (151)    SEELFTTYGTHYLSEVLVGGRADYVATTKTSAFSSDIQISVVAECSFKSV
IPD079Ah    (151)    SEELFTTYGTHYLSEVLVGGRADYVATTKTSAFSSDIQISVVAECSFKSV
IPD079Ai    (151)    SEELFTTYGTHYLSEVLVGGRADYVATTKTSAFSSDIQISVGAECSFKSV
IPD079Aj    (151)    SEELFTTYGTHYLSEVLVGGRADYVATTKTSAFSSDIQISVGAECSFKSV
IPD079Ak    (151)    SEELFTTYGTHYLSEVLVGGRADYVATTKTSAFSSDIQISVGAECSFKSV
IPD079Al    (151)    SEELFTTYGTHYLSEVLVGGRADYVATTKTSAFSSDIQISVVAECSFKSV
IPD079Am    (151)    SEELFTTYGTHYLSEVLVGGRADYVATTKTSAFSSDIQISVVAECSFKSV
IPD079An    (151)    SEELFTTYGTHYLSEVLVGGRADYVATTKTSAFSSDIQISVVAECSFKSV
IPD079Ao    (151)    SEELFTTYGTHYLSEVLVGGRADYVATTKTSAFSSDIQISVGAECSFKSV
IPD079Ap    (151)    SEELFTTYGTHYLSEVLVGGRADYVATTKTSAFSSDIQISVVAECSFKSV
IPD079Aq    (151)    LEELFTTYGTHYLSEVLVGGRADYVATTKTSAFSSEIQISVVAECSFKSV
IPD079Ar    (151)    SEELFTTYGTHYLSGVLVGGRADYVATTKTSAFSSDIQISVVAECSFKSV
IPD079As    (151)    SEELFTTYGTHYLSEVLVGGRADYVATTKTSAFSSDIQISVGAECSFKSV
IPD079At    (151)    LEELFTTYGTHYLSEVLVGGRADYVATTKTSAFSSEIQISVVAECSFKSV
IPD079Au    (151)    SDELFTTYGTHYLSEVLVGGRADYVATTKTSAFSSDIQISVVAECSFKSV
IPD079Av    (151)    LEELFTTYGTHYLSEVLVGGRADYVATTKTSAFSSEIQISVVAECSFKSV
IPD079Aw    (151)    SEELFTTYGTHYLSEVLVGGRADYVATTKTSAFSSEIQISVVAECSFKSV
IPD079Ax    (151)    SEELFTTYGTHYLSEVLVGGRADYVATTKTSAFSSEIQISVVAECSFKSV
IPD079Az    (151)    SEELFTTYGTHYLSEVLVGGRADYVATTKTSAFSSDIQISVVAESSFKSV
IPD079Ba    (151)    SEELFTTYGTHYLSEVLVGGRADYVATTKTSAFSSDIQISVVAECSFKSV
IPD079Bb    (151)    EVELLSTYGTHYMGEVLVGGRADYLATTKTSAFSSDTKISTVAESSFKSV
IPD079Bc    (151)    EVELLSTYGTHYMGEVLVGGRADYLATTKTSAFSSDTKISTVAESSFKSV
IPD079Bd    (151)    SEELFTTYGTYYLSEVLVGGRADYVATTKTSAFSSDTQISVVAESSFKSV
IPD079Be    (151)    SEELFTTYGTYYLSEVLVGGRADYVATTKTSAFSSDTQISVVAESSFKSV
IPD079Bf    (151)    SEELFTTYGTYYLSEVLVGGRADYVATTKTSAFSSDTQISVVAESSFKSV
IPD079Bg    (151)    SEELFTTYGTYYLSEVLVGGRADYVATTKTSAFSSDTQISVVAESSFKSV
IPD079Bh    (151)    SEELFSTYGTYYLSEVLVGGRADYVATTKTSAFSSDTQISVVAESSFKSV
IPD079Bi    (151)    AVELLSTYGTHYLGEVLVGGRADFVATTKTSAFSSDTKISTVAESSFKSV
IPD079Bj    (151)    AVELLSTYGTHYLGEVLVGGRADFVATTKTSAFSSDTKISTVAESSFKSV
IPD079Bk    (151)    AVELLSTYGTHYLGEVLVGGRADYVATTKTSAFSSSTKISTVAESSFKSM
IPD079Bl    (151)    AVELLSTYGTHYLGEVLVGGRADYVATTKTSAFSSSTKISTVAESSFKSM
IPD079Bm    (151)    AVELLSTYGTHYLGEVLVGGRADYVATTKTSAFSSSTKISTVAESFFKSM
```

Fig. 1E

```
                    201                                                250
IPD079Aa    (201)   AGMEVSAEYKELIKKFQENSSTSLYALGGTALSSITDTASYNAWFSSIDT
IPD079Ab    (201)   AGMDVSSKYKELIQIFQENSFTSLYAIGGTALSSITDTDTYNAWLSSIDT
IPD079Ac    (201)   AGMDVSSKYKELIQIFQENSFTSLYAIGGTALSSITDTDTYNAWLSSIDT
IPD079Ad    (201)   AGMDVSAKYKELIQKFQENSSTSLYAIGGTTISSITDKDTYNAWLSSIDT
IPD079Ae    (201)   AGMDVSAKYKELIQKFQENSSTSLYAIGGTTISSITDKDTYNAWLSSIDT
IPD079Af    (201)   VGMDVSAKYKELIQKFQENSSTSLYAIGGTEISSITDTDTYNAWLSSIDT
IPD079Ag    (201)   AGMDVSAKYKELIQKFQENSSTSLYAIGGTTISSITDKDTYNAWLSSIDT
IPD079Ah    (201)   AGMDVSAKYKELIQKFQENSSTSLYAIGGTTISSITDKDTYNAWLSSIDT
IPD079Ai    (201)   AGMDVSAKYKELIQKFQENSSTSLYAIGGTAISSITDTDTYNAWLSSIDT
IPD079Aj    (201)   AGMDVSAKYKELIQKFQENSSTSLYAIGGTAISSITDTDTYNAWLSSIDT
IPD079Ak    (201)   AGMDVSAKYKELIQKFQENSSTSLYAIGGTAISSITDTDTYNAWLSSIDT
IPD079Al    (201)   AGMDVSAKYKELIQKFQENSSTSLYAIGGTTISSITDKDTYNAWLSSIDT
IPD079Am    (201)   AGMDVSAKYKELIQKFQENSSTSLYAIGGTTISSITDKDTYNAWLSSIDT
IPD079An    (201)   AGMDVSAKYKELIQKFQENSSTSLYAIGGTTISSITDKDTYNAWLSSIDT
IPD079Ao    (201)   VGMDVSAKYKELIQKFQENSSTSLYAIGGTAISSITDTDTYNAWLSSIDT
IPD079Ap    (201)   AGMDVSAKYKELIQKFQENSSTSLYAIGGTTISSITDKDTYNAWLSSIDT
IPD079Aq    (201)   AGMDVSAKYKELIQKFQENSSTSLYAIGGTTISSITDKDTYNAWLSSIDT
IPD079Ar    (201)   AGMDVSAKYKELIQKFQENSSTSLYAIGGTTISSITDKDTYNAWLSSIDI
IPD079As    (201)   AGMDVSAKYKELIQKFQENSSTSLYAIGGTTISSITDKDTYNAWLSSIDT
IPD079At    (201)   AGMDVSAKYKELIQKFQENSSTSLYAIGGTTISSITDKDTYNAWLSSIDT
IPD079Au    (201)   AGMDVSAKYKELIQKFQENSSTSLYAIGGTTISSITDKDTYNAWLSSIDT
IPD079Av    (201)   AGMDVSAKYKELIQKFQENSSTSLYAIGGTTISSITDKDTYNAWLSSIDT
IPD079Aw    (201)   AGMDVSAKYKELIQKFQENSSTSLYAIGGTTISSITDKDTYNAWLSSIDT
IPD079Ax    (201)   AGMDVSAKYKELIQKFQENSSTSLYAIGGTTISSITDKDTYNAWLSSIDT
IPD079Az    (201)   AGMDVSSKYKELIQIFQENSSTSLYAIGGTALSSITDTDTYNAWLSSIDT
IPD079Ba    (201)   AGMDVSAKYKELIQKFQENSSTSLYAIGGTTISSITDKDTYNAWLSSIDT
IPD079Bb    (201)   AGMKVSAEQKQLIEKFQENSSTSLYAIGGSALSSITDTATYNAWLSSIDT
IPD079Bc    (201)   AGMKVSAEQKQLIEKFQENSSTSLYAIGGSALSSITDTATYNAWLSSIDT
IPD079Bd    (201)   AGMEVSSQYKELIKKFQENSSTRLYAIGGTALSSITDTATYNAWLSSIDT
IPD079Be    (201)   AGMEVSSQYNELIKKFQENSSTRLYAIGGTALSSITDTATYNAWLSSIDT
IPD079Bf    (201)   AGMEVSSQYKELIKKFQENSSTRLYAIGGTALSSITDTATYNAWLSSIDT
IPD079Bg    (201)   AGMEVSSQYKELIKKFQENSSTRLYAIGGTALSSITDTATYNAWLSSIDT
IPD079Bh    (201)   AGMEVSSQYKELIKKFQENSSTRLYAIGGTALSSITDTATYNAWLSSIDT
IPD079Bi    (201)   AGMKVSAEQKQLIENFQENSSTSLYAIGGSALSSITDTATYNAWLSSIDT
IPD079Bj    (201)   AGMKVSAEQKQLIENFQENSSTSLYAIGESALSSITDTATYNAWLSSIDT
IPD079Bk    (201)   AGMKVSAAHMQLIQKFQENSSTSLYAIGGSALSNITDATTYNAWLRSIDT
IPD079Bl    (201)   AGMKVSAAHMQLIQKFQENSSTSLYAIGGSALSNITDATTYNAWLRSIDT
IPD079Bm    (201)   AGMKVSAAHMQLIQKFQENSSTSLYAIGGSALSNITDATTYNAWLRSIDT
```

Fig. 1F

```
                   251                                                300
IPD079Aa   (251)   LPVFCGFTYESLQPIWELAESPQRQEILQKATKTFIPPEIRRNAIVDVDI
IPD079Ab   (251)   LPVFCGFTCESLQPIWELAESPQRQEILQKATMTFIPPEIRRNAIVDVDI
IPD079Ac   (251)   LPVFCGFTCESLQPIWELAESPQRQEILQKATMTFIPPEIRRNAIVDVDI
IPD079Ad   (251)   RPVFCGFTYESLQPIWELAESPQRQEILQKATKTFISPEIKRNAIVDVDI
IPD079Ae   (251)   RPVFCGFTYESLQPIWELAESPQRQEILQKATKTFIPPEIKRNAIVDVDI
IPD079Af   (251)   RPVFCGFTYESLQPIWELAESPQRQEILQKATKTFISPEIKRNAIVDVDI
IPD079Ag   (251)   RPVFCGFTYESLQPIWELAESPQRQEILQKATKTFISPEIKRNAIVDVDI
IPD079Ah   (251)   RPVFCGFTYESLQPIWELAESPQRQEILQKATKTFIPPEVRRNAIVDVEI
IPD079Ai   (251)   RPVFCGFTYESLQPIWELAESPQRQEILQKATKTFISPEIKRNAIVDVDI
IPD079Aj   (251)   RPVFCGFTYESLQPIWELAESPQRQEILQKATKTFISPEIKRNAIVDVDI
IPD079Ak   (251)   RPVFCGFTYESLQPIWELAESPQRQEILQKATKTFISPEIKRNAIVDVDI
IPD079Al   (251)   RPVFCGFTYESLQPIWELAESPQRQEILQKATKTFISPEIKRNAIVDVDI
IPD079Am   (251)   RPVFCGFTYESLQPIWELAESPQRQEILQKATKTFIPPEIKRNAIVDVDI
IPD079An   (251)   RPVFCGFTYESLQPIWELAESPQRQEILQNATKTFIPPEIKRNAIVDVDI
IPD079Ao   (251)   RPVFCGFTYESLQPIWELAESPQRQEILQKATKTFISPEIKRNAIVDVDI
IPD079Ap   (251)   RPVFCGFTYESLQPIWELAESPQRQEILQKATKTFIPPEIKRNAIVDVDI
IPD079Aq   (251)   RPVFCGFTYESLQPIWELAESPQRQEILQKATKTFIPPEIKRNAIVDVDI
IPD079Ar   (251)   RPVFCGFTYESLQPIWELAESPQRQEILQKATKTFIPPEIKRNAIVDVDI
IPD079As   (251)   RPVFCGFTYESLQPIWELAESPQRQEILQKATKTFISPEIKRNAIVDVDI
IPD079At   (251)   RPVFCGFTYESLQPIWELAESPQRQEILQKATKTFISPEIKRNAIVDVDI
IPD079Au   (251)   RPVFCGFTYESLQPIWELAESPQRQEILQKATKTFISPEIKRNAIVDVDI
IPD079Av   (251)   RPVFCGFTYESLQPIWELAESPQRQEILQKATKTFIPPEIKRNAIVDVDI
IPD079Aw   (251)   RPVFCGFTYESLQPIWELAESPQRQEILQKATKTFIPPEIKRNAIVDVDI
IPD079Ax   (251)   RPVFCGFTYESLQPIWELAESPQRQEILQKATKTFIPPEIKRNAIVDVDI
IPD079Az   (251)   LPVFCGFTYESLQPIWELAESPQRQEILQKATKTFIPPEIRRNAIVDVDI
IPD079Ba   (251)   RPVFCGFTYESLQPIWELAESPQRQEILQKATKTFISPEIKRNAIVDVDI
IPD079Bb   (251)   RPVFCGFTRDSLRPIWELAESPQRREILRKATQTFIPPEITRNAVVGVDI
IPD079Bc   (251)   RPVFCGFTRDSLRPIWELAESPQRQEILQKATKAFISPEIKRNAIVDVDI
IPD079Bd   (251)   RPVFCGFTRDSLRPIWELAESPQRREILRKATQTFIPPEITRNAIVGVDI
IPD079Be   (251)   LPVFCGFTSASLKPIWELAESSQRQEILQKAAQTFIPLEIRRNAIVDVAI
IPD079Bf   (251)   LPVFCGFTSASLKPIWELAESSQRQEILQKAAQTFIPLEIRRNAIVDVAI
IPD079Bg   (251)   LPVFCGFTSASLKPIWELAESSQRQEILQKAAQTFIPLEIRRNAIVDVAI
IPD079Bh   (251)   LPVFCGFTSASLKPIWELAESSQRQEILQKAAQTFIPLEIRRNAIVDVAI
IPD079Bi   (251)   RPVFCGFTRDSLRPIWELAESPQRREILRKATQTFIPPEITRNAIVGVDI
IPD079Bj   (251)   RPVFCGFTRDSLRPIWELAESPQRREILRKATQTFIPPEITRNAIVGVDI
IPD079Bk   (251)   RPVFCGFTRDSLRPIWELAESPQRREILRKATQTFIPSGITRNAIVGIDI
IPD079Bl   (251)   RPVFCGFTRDSLRPIWELAESPQRREILRKATQTFIPSGITRNAIVGIDI
IPD079Bm   (251)   RPVFCGFTRDSLRPIWELAESPQRREILRKATQTFIPSGITRNAIVGIDI
```

Fig. 1G

```
              301                                                      350
IPD079Aa (301) IVSDNYWVNPPYGYTKIDYDLNRNAKGKYIFLCYNQQKISVAGSPADPTP
IPD079Ab (301) IVSDNYSVNPPYGYTKIDYDLNRNAEGKYIFLCYNQQKISVAGSPADPKP
IPD079Ac (301) IVSDNYSVNPPYGYTKIDYDLNRNAEGKYIFLCYNQQKISVAGSPADPKP
IPD079Ad (301) IVSDNYGVNPPYGYTKIDYDLNHNAKGKFIFLCYNQQKISVAGSPADPKP
IPD079Ae (301) IVSDNYGVNPPYSYTKIDYDLNHNAKGKFIFLCYNQQKISVAGSPADPKP
IPD079Af (301) IVSDNYGVNPPYGYTKIDYDLNRNAKGKFIFLCYNQQKISVAGSPADPKP
IPD079Ag (301) IVSDNYGVNPPYGYTKIDYDLNHNAKGKFIFLCYNQQKISVAGSPADPKP
IPD079Ah (301) TVSDSYWVNPPYGYTKIDYDLNRNAKGKYIFLCYNQQKISVAGSPADPKP
IPD079Ai (301) IVSDNYGVNPPYGYTKIDYDLNRNAKGKFIFLCYNQQKISVAGSPADPKP
IPD079Aj (301) IVSDNYGVNPPYGYTKIDYDLNRNAKGKFIFLCYNQQKISVAGSPADPKP
IPD079Ak (301) IVSDNYGVNPPYGYTKIDYDLNRNAKGKFIFLCYNQQKISVAGSPADPKP
IPD079Al (301) IVSDNYGVNPPYGYTKIDYDLNRNAKGKFIFLCYNQQKISVAGSPADPKP
IPD079Am (301) IVSDNYGVNPPYGYTKIDYDLNRNAKGKFIFLCYNQQKISVAGSPADPKP
IPD079An (301) IVSDNYGVNPPYGYTKIDYDLNHNAKGKFIFLCYNQQKISVAGSPADPKP
IPD079Ao (301) IVSDNYGVNPPYGYTKIDYDLNRNAKGKFIFLCYNQQKISVAGSPADPKP
IPD079Ap (301) IVSDNYGVNPPYSYTKIDYDLNHNAKGKFIFLCYNQQKISVAGSPADPKP
IPD079Aq (301) IVSDNYGVNPPYSYTKIDYDLNHNAKGKFIFLCYNQQKISVAGSPADPKP
IPD079Ar (301) IVSDNYGVNPPYGYTKIDYDLNRNAKGKFIFLCYNQQKISVAGSPADPKP
IPD079As (301) IVSDNYGVNPPYGYTKIDYDLNRNAKGKFIFLCYNQQKISVAGSPADPKP
IPD079At (301) IVSDNYGVNPPYGYTKIDYDLNRNAKGKFIFLCYNQQKISVAGSPADPKP
IPD079Au (301) IVSDNYGVNPPYGYTKIDYDLNRNAKGKFIFLCYNQQKISVAGSPADPKP
IPD079Av (301) IVSDNYGVNPPYSYTKIDYDLNHNAKGKFIFLCYNQQKISVAGSPADPKP
IPD079Aw (301) IVSDNYGVNPPYGYTKIDYDLNRNAKGKFIFLCYNQQKISVAGSPADPKP
IPD079Ax (301) IVSDNYGVNPPYSYTKIDYDLNRNAKGKYIFLCYNQQKISVAGSPADPKP
IPD079Az (301) IVSDNYWVNPPYGYTKIDYDLNRNAKGKYIFLCYNQQKISVAGSPADPKP
IPD079Ba (301) IVSDNYGVNPPYGYTKIDYDLNRGAKGKFIYLCYKQQKISVAGSPADPKP
IPD079Bb (301) IMSENYWVNPPYGYTKIDYDLNRNAKGKYIFLCYKQQKISVAGSPADPKP
IPD079Bc (301) IVSDNYGVNPPYGYTKIDYDLNRNAKGKFIFLCYNQQKISVAGSPADPKP
IPD079Bd (301) IMSDNYWVNPPYGYTKIDYDLNRNAKGKYIFLCYKQQKISVAGSPADPKP
IPD079Be (301) IVSDNHIVNPPYGFTKIDFDLNRGAKGKFIYLCYKQQKISVAGSPADPKP
IPD079Bf (301) IVSDNHIVNPPYGFTKIDFDLNRGAKGKFIYLCYKQQKISVAGSPADPKP
IPD079Bg (301) IVSDNHIVNPPYGFTKIDFDLNRGAKGKFIYLCYKQQKISVAGSPADPKP
IPD079Bh (301) IVSDNHIVNPPYGFTKIDFDLNRGAKGKFIYLCYKQQKISVAGSPADPKP
IPD079Bi (301) IMSDNYWVNPPYGYTKIDYDLNRNAKGKYIFLCYKQQKISVAGSPADPKP
IPD079Bj (301) IMSDNYWVNPPYGYTKIDYDLNRNAKGKYIFLCYKQQKISVAGSPADPKP
IPD079Bk (301) IISDSYWVNPPYGYTKINYDLNRNAKGKYIFLCYKQQKISVAESPADPKP
IPD079Bl (301) IISDSYWVNPPYGYTKINYDLNRNAKGKYIFLCYKQQKISVAESPADPKP
IPD079Bm (301) IISDSYWVNPPYGYTKINYDLNRNAKGKYIFLCYKQQKISVAESPADPKP
```

Fig. 1H

```
              351                                                400
IPD079Aa (351) ITALYVASGDDDHPYVPIGYTRINSDLNEGAGGKYIYLCYTKDPAAIPSD
IPD079Ab (351) ITALDVASGDDDDPDVPPGYTRINSDLNEGAGGKYIYLCYTKDPAAIPSD
IPD079Ac (351) ITALDVASGDDNDPDVPPGYTRINSDLNEGAGGKYIYLCYTKDPAAIPSD
IPD079Ad (351) ITALYVASGDDDHPYVPPGYTRISSDLNEGAGGKFIYLCYTKDPAAIPSD
IPD079Ae (351) ITALYVASGDDDHPYVPPGYTRISSDLNEGAGGKFIYLCYTKDPAAIPSD
IPD079Af (351) ITALYVASGDDDHPYVPPGYTRISSDLNEGAGGKFIYLCYTKDPAAIPSD
IPD079Ag (351) ITVLYVASGDDDHPYVPPGYTRISSDLNEGAGGKFIYLCYTKDPAAIPSD
IPD079Ah (351) ITALYVASGDDNNPYIPPGYTRINSDLNEGAGGKFIYLCYTKDPAAIPSD
IPD079Ai (351) ITALYVASGDDDHPYVPPGYTRISSDLNEGAGGKFIYLCYTKDPAAIPSD
IPD079Aj (351) ITVLYVASGDDDHPYVPPGYTRISSDLNEGAGGKFIYLCYTKDPAAIPID
IPD079Ak (351) ITALYVASGDDDHPYVPPGYTRISSDLNEGAGGKFIYLCYTKDPAAIPSD
IPD079Al (351) ITVLYVASGDDDHPYVPPGYTRISSDLNEGAGGKFIYLCYTKDPAAIPID
IPD079Am (351) ITALYVASGDDDHPYVPPGYTRISSDLNEGAGGKFIYLCYTKDPAAIPSD
IPD079An (351) ITALYVASGDDDHPYVPPGYTRISSDLNEGAGGKFIYLCYTKDPAAIPSD
IPD079Ao (351) ITALYVASGDDDHPYVPPGYTRISSDLNEGAGGKFIYLCYTKDPAAIPSD
IPD079Ap (351) ITALYVASGDDDHPYVPPGYTRISSDLNEGAGGKFIYLCYTKDPAAIPSD
IPD079Aq (351) ITALYVASGDDDHPYVPPGYTRISSDLNEGAGGKFIYLCYTKDPAAIPSD
IPD079Ar (351) ITALYVASGDDDHPYVPPGYTRISSDLNEGAGGKFIYLCYTKDPAAIPSD
IPD079As (351) ITALYVASGDDDHPYVPPGYTRISSDLNEGAGGKFIYLCYTKDPAAIPSD
IPD079At (351) ITALYVASGDDDHPYVPPGYTRISSDLNEGAGGKFIYLCYTKDPAAIPSD
IPD079Au (351) ITVLYVASGDDDHPYVPPGYTRISSDLNEGAGGKFIYLCYTKDPAAIPID
IPD079Av (351) ITALYVASGDDDHPYVPPGYTRISSDLNEGAGGKFIYLCYTKDPAAIPSD
IPD079Aw (351) ITALYVASGDDDHPYVPPGYTRISSDLNEGAGGKFIYLCYTKDPAAIPSD
IPD079Ax (351) ITALYVASGDDNNPYIPPGYTRINSDLNEGAGGKFIYLCYTKDPAAIPSD
IPD079Az (351) ITALYVASGDDDHPYIPPGYTRINSDLNEGAGGKYIYLCYTKDPAAIPSD
IPD079Ba (351) ITALNVSSDYHDPSGPSGYTMIYTDLNQGVGGKFIYLCYTKDPAAIPSD
IPD079Bb (351) ITALYVASGDDDNPYVPPGYTKIDQDLNKDAGGKFIYLSYTKDPAAIPND
IPD079Bc (351) ITALYVASGDDNNPYIPPGYTRINSDLNEGAGGKFIYLCYTKDPAAIPSD
IPD079Bd (351) ITALYVASGDDDNPYVPAGYTMINTDLNQGAKGKFIYLCYTKDPAAIPSD
IPD079Be (351) ITALNVVSSDYHDPSAPSGYTMINTDLNQGAKGKFIYLCYTKDPAAIPSD
IPD079Bf (351) ITALNVVSSDYHDPSAPSGYTMINTDLNQGAKGKFIYLCYTKDPAAIPSD
IPD079Bg (351) ITALNVVSSDYHDPSAPSGYTMINTDLNQGAKGKFIYLCYTKDPAAIPSD
IPD079Bh (351) ITALNVVSSDYHDPSAPSGYTMINTDLNQGAKGKFIYLCYTKDPAAIPSD
IPD079Bi (351) ITALYVASGDDNPYVPAGYTKIDKDLNKDAGGKFIYLCYTKDPAAIPND
IPD079Bj (351) ITALYVASGDDNPYVPAGYTKIDKDLNKDAGGKFIYLCYTKDPAAIPND
IPD079Bk (351) ITALYVSSGDDDNPYVPPGYTKINKDLNKGAGGKFIYLCYTKDPAAIPSH
IPD079Bl (351) ITALYVSSGDDDNPYVPPGYTKINKDLNKGAGGKFIYLCYTKDPAAIPSH
IPD079Bm (351) ITALYVSSGDDDNPYVPPGYTKINKDLNKGAGGKFIYLCYTKDPAAIPSH
```

Fig. 1I

```
              401                                                   450
IPD079Aa (401) EDGLPIRGIRVIGNEKVENVVTPYGFTKIDKDLNEGAGGDYIFVCFSRHLD
IPD079Ab (401) EDGLPIRGIRVIGNEKLENVVTPYGFTKIDKDLNEGAGGDYVFVCFSRHLD
IPD079Ac (401) EDGLPIRGIRVIGNEKLENVVTPYGFTKIDKDLNEGAEGDYVFVCFSRHLD
IPD079Ad (401) EDGLPIRGIRVIGNENIDNVVTPYGFTKIDKDLNEGAGGDFIFVRFSPHLD
IPD079Ae (401) EDGLPIRGIRVIGNENIDNVVTPYGFTKIDKDLNEGAGGDFIYVRFSPHLD
IPD079Af (401) EDGLPIRGIRVIGNENIENVVTPYGFTKIDKDLNEGAGGDFIFVRFSPHLD
IPD079Ag (401) EDGLPIRGIRVIGNENIDNVVTPYGFTKIDKDLNEGAGGDFIFVRFSPHLD
IPD079Ah (401) EDGLPIRGIRVIGNENGQNVVTPYGFTKIDKDLNEGAGGDYIFVRFSPHLD
IPD079Ai (401) EDGLPIRGIRVIGNENIDNVVTPYGFTKIDKDLNEGAGGDFIYVRFSPHLD
IPD079Aj (401) EDGLPIRGIRVIGNENIENVVTPYGFTTIDKDLNEGAGGDFIFVRFSPHLD
IPD079Ak (401) EDGLPIRGIRVIGNENIDNVVTPYGFTKIDKDLNEGAGGDFIYVRFSPHLD
IPD079Al (401) EDGLPIRGIRVIGNENIENVVTPYGFTTIDKDLNEGAGGDFIFVRFSPHLD
IPD079Am (401) EDGLPIRGICVIGNENIENVVTPYGFTKIDKDLNEGAGGDFIFVRFSPHLD
IPD079An (401) EDGLPIRGIRVIGNENIDNVVTPYGFTKIDKDLNEGAGGDFIFVRFSPHLD
IPD079Ao (401) EDGLPIRGIRVIGNENIENVVTPYGFTKIDKDLNEGAGGDFIFVRFSPHLD
IPD079Ap (401) EDGLPIRGIRVIGNENIDNVVTPYGFTKIDKDLNEGAGGDFIYVRFSPHLD
IPD079Aq (401) EDGLPIRGIRVIGNENIDNVVTPYGFTKIDKDLNEGAGGDFIFVRFSPHLD
IPD079Ar (401) EDGLPIRGIRVIGNENIENVVTPYGFTTIDKDLNEGAGGDFIYVRFSPHLD
IPD079As (401) EDGLPIRGIRVIGNENIDNVVTPYGFTKIDKDLNEGAGGDFIFVRFSPHLD
IPD079At (401) EDGLPIRGIRVIGNENGENVVTPYGFTKIDKDLNEGAGGDYIFVRFSPHLD
IPD079Au (401) EDGLPIRGIRVIGNENIENVVTPYGFTTIDKDLNEGAGGDFIFVRFSPHLD
IPD079Av (401) EDRLPIRGIRVIGNENIDNVVTPYGFTKIDKDLNEGAGGDFIYVRFSPHLD
IPD079Aw (401) EDGLPIRGICVIGNENIENVVTPYGFTKIDKDLNEGAGGDFIFVRFSPHLD
IPD079Ax (401) EDGLPIRGIRVIGNENGENVVTPYGFTKIDKDLNEGAGGDYIFVRFSPHLD
IPD079Az (401) EDGLPIRGIRVIGNEKVENVVTPYGFTKIDKDLNEGAGGDYIFVCFSRHLD
IPD079Ba (401) EDGLPIRGIRVIGNPQFGNVVTPYGFTRIDKDLNEGAKGEFIYVRFSPHLD
IPD079Bb (401) EDGLPIRGIRVIGNEKLENVVTPYGFTRIDEDLNKDAKGDYIFVRFSPHLD
IPD079Bc (401) EDGLPIRGIRVIGNENGENVVTPYGFTKIDKDLNEGAGGDYIFVRFSPHLD
IPD079Bd (401) EDGLPIRGLRVIGNPQVENVVTPYGFTRINKDLNEGAKGEYIYVCFSRHLD
IPD079Be (401) EDGLPIRGLRVIGNPQVENVVTPYGFTRINKDLNEGAKGEFIYVCFSRHLD
IPD079Bf (401) EDGLPIRGLRVIGNPQVENVVTPYGFTRINKDLNEGAKGEFIYVCFSRHLD
IPD079Bg (401) EDGLPIRGLRVIGNPQVENVVTPYGFTRINKDLNEGAKGEFIYVCFSRHLD
IPD079Bh (401) EDGLPIRGLRVIGNPQVENVVTPYGFTRINKDLNEGAKGEYIYVCFSRHLD
IPD079Bi (401) EDGLPIRGIRVIGNEKLENVVTPYGFTRIDEDLNKGAKGDYIFVCFSRHLD
IPD079Bj (401) EDGLPIRGIRVIGNEKLENVVTPYGFTRIDEDLNKGAKGDYIFVCFSRHLD
IPD079Bk (401) EDGLPIRGIRVIGNEKLENVVTPYGYTRIDEDLNKGAGGDYIFVCFSRHLD
IPD079Bl (401) EDGLPIRGIRVIGNEKLENVVTPYGYTRIDEDLNKGAGGDYIFVCFSRHLD
IPD079Bm (401) EDGLPIRGIRVIGNEKLENVVTPYGYTRIDEDLNKGAGGDYIFVCFSRHLD
```

Fig. 2A

```
                    1                                                50
IPD079Ea   (1) MEPNKGGAPAMKNVAKPSTKRLIPSSIAASSQTSANALTEPLPGSDAIGQ
IPD079Eaa  (1) MEPNKGGAPAMKNVAKPSTKRLIPSSIAASSQTSANALTEPLPGSDSIGQ
IPD079Eab  (1) MEPNKGGAPAMKNVAKPSTKRLIPSSIAASSQTSANALTEPLPGSDAIGQ
IPD079Eac  (1) MEPNKGGAPAMKNVAKPSTKTLIPSSIAASSQTAANALTEPLPGSDAIGQ
IPD079Ead  (1) MEPKTGGAPAMKNVAKPSTKRLIPSSIAASSQTSANALTEPLPGSDAIGQ
IPD079Eae  (1) MEPKTGGAPAMKNVAKPSTKRLIPSSIAASSQTSANALTEPLPGSDAIGQ
IPD079Eb   (1) MEPNKGGAPAMKNVAKPSTKRLIPSSIAASSQTSANALTEPLPGSDAIGQ
IPD079Ec   (1) MEPNKGGAPAMKNVAKPSTKRLIPSSIAASSQTSANALTEPLPGSDAIGQ
IPD079Ed   (1) MEPNKGGAPAMKNVAKPSTKRLIPSSIAASSQTSANALTEPLPGSDAIGQ
IPD079Ee   (1) MEPNKGGAPAMKNVAKPSTKTLIPSSIAASSQTAANALTEPLPGSDAIGQ
IPD079Ef   (1) MEPNKGGAPAMKNVAKPSTKRLIPSSIAASSQTSANALTEPLPGSDAIGQ
IPD079Eg   (1) MEPNKGGAPAMKNVAKPSTKRLIPSSIAASSQTSANALTEPLPGSDAIGQ
IPD079Eh   (1) MEPNKGGAPAMKNVAKPSTKRLIPSSIAASSQTSANALTEPLPGSDAIGQ
IPD079Ei   (1) MEPNKGGAPAMKNVAKPSTKRLIPSSIAASSQTSANALTEPLPGSDAIGQ
IPD079Ej   (1) MEPNKGGAPAMKNVAKPSTKRLIPSSIAASSQTSANALTEPLPGSDAIGQ
IPD079Ek   (1) MEPNKGGAPAMKNVAKPSTKRLIPSSIAASSQTSANALTEPLPGSDAIGQ
IPD079El   (1) MEPNKGGAPAMKNVAKPSTKRLIPSSIAASSQTSANALTEPLPGSDAIGQ
IPD079Em   (1) MEPNKGGAPAMKNVAKPSTKRLIPSSIAASSQTSANALTEPLPGSDAIGQ
IPD079En   (1) MEPNKGGAPAMKNVAKPSTKRLIPSSIAASSQTSANALTEPLPGSDAIGQ
IPD079Eo   (1) MEPNKGGAPAMKNVAKPSTKRLIPSSIAASSQTSANALTEPLPGSDAIGQ
IPD079Ep   (1) MEPNKGGAPAMKNVAKPSTKRLIPSSIAASSQTSANALTEPLPGSDAIGQ
IPD079Eq   (1) MEPNKGGAPAMKNVAKPSTKRLIPSSIAASSQTSANALTEPLPGSDAIGQ
IPD079Er   (1) MEPNKGGAPAMKNVAKPSTKRLIPSSIAASSQPSANALTEPLPGSDAIGQ
IPD079Es   (1) MEPNKGGAPAMKNVAKPSTKRLIPSSIAASSQTSANALTEPLPGSDAIGQ
IPD079Et   (1) MEPNKGGAPAMKNVAKPSTKRLIPSSIAASSQTSANALTEPLPGSDAIGQ
IPD079Eu   (1) MEPNKGGAPAMKNVAKPSTKRLIPSSIAASSQTSANALTEPLPGSDAIGQ
IPD079Ev   (1) MEPKTGGAPAMKNVAKPSTKTLIPSSIAASSQTAANALTEPLPGSDAIGQ
IPD079Ew   (1) MEPNKGGAPAMKNVAKPSTKRLIPSSIAASSQTSANALTEPLPGSDAIGQ
IPD079Ey   (1) MEPNKGGAPAMKNVAKPSTKRLIPSSIAASSQASANALTEPLPGSDAIGQ
IPD079Ex   (1) MEPNKGGAPAMKNVAKPSTKRLIPSSIAASSQTSANALTEPLPGSDAIGQ
IPD079Ez   (1) MEPNKGGAPAMKNVAKPSTKRLIPSSIAASSQTSANALTEPLPGSDSIGQ
IPD079Fa   (1) MEPNKGGVPPMKNVAKPSTKRLIPSSFARSLQTSANASIEPLPGSDAIGN
```

Fig. 2B

```
                  51                                                100
IPD079Ea   (51)   SYDAFGFFANPRSIMKELFEFSPQEEIVVEGNTWLLSSDFVYTAIRDTET
IPD079Eaa  (51)   SYDAFGFFANPRSIMKELFEFSPQEEIVVEGNTWLLSSDFVYTAIRDTET
IPD079Eab  (51)   SYDAFGFFANPRSIMKELFEFSPQEEIVVEGNTWLLSSDFVYTAIRDTET
IPD079Eac  (51)   SYDAFGFFANPRSIMKELFEFSPQEEIVVEGNTWLLSSDFVYTAIRDSEA
IPD079Ead  (51)   SYDAFGFFANPRSIMKELFEFSPQEEIVVEGNTWLLSSDFVYTAIRDTET
IPD079Eae  (51)   SYDAFGFFANPRSIMKELFEFSPQEEIVVEGNTWLLSSDFVYTAIRDTET
IPD079Eb   (51)   SYDAFGFFANPRSIMKELFEFSPQEEIVVEGNTWLLSSDFVYTAIRDTET
IPD079Ec   (51)   SYDAFGFFANPRSIMKELFEFSPQEEIVVEGNTWLLSSEFVYTAIRDTET
IPD079Ed   (51)   SYDAFGFFANPRSIMKELFEFSPQEEIVMEGNTWLLSSDFVYTAIRDTET
IPD079Ee   (51)   SYNAFGFFANPRSIMKELFEFSPQEEIVVEGNTWLLSSDFVYTAIRDSEA
IPD079Ef   (51)   SYDAFGFFANPRSIMKELFEFSPQEEITVEGNTWLLSSDFVYTAIRDTET
IPD079Eg   (51)   SYDAFGFFANPRSIMKELFEFSPQEEIVVEGNTWLLSSDFVYTAIRDSEA
IPD079Eh   (51)   SYDAFGFFANPRSIMKELFEFSPQKEIVVEGNTWLLSSDFVYTAIRDTET
IPD079Ei   (51)   SYDAFGFFANPRSIMKELFEFSPQEEIVVEGNTWLLSSDFVYTAIRDTET
IPD079Ej   (51)   SYDAFGFFANPRSIMKELFEFSPQEEIVVEGNTWLLSSDFVYTAIRDTET
IPD079Ek   (51)   SYDAFGFFANPRSIMKELFEFSPQEEIVVEGNTWLLSSDFVYTAIRDTET
IPD079El   (51)   SYDAFGFFANPRSIMKELFEFSPQEEIVVEGNTWLLSSDFVYTAIRDTET
IPD079Em   (51)   SYDAFGFFANPRSIMKELFEFSPQEEIVVEGNTWLLSSDFVYTAIRDTET
IPD079En   (51)   SYDAFGFFANPRSIMKELFEFSPQEEIVVEGNTWLLSSDFVYTAIRDTET
IPD079Eo   (51)   SYDAFGFFANPRSIMKELFEFTPQEEIVVEGNTWLLSSDFVYTAIRDTET
IPD079Ep   (51)   SYDAFGFFANPRSIMKELFEFSPQEEIVVEGNTWLLSSDFVYTAIRDTET
IPD079Eq   (51)   SYDAFGFFANPRSIMKELFEFSPQEEIVVEGNTWLLSSDFVYTAIRDTET
IPD079Er   (51)   SYDAFGFFANPRSIMKELFEFSPQEEIVVEGNTWLLSSDFVYTAIRDTET
IPD079Es   (51)   SYDAFGFFANPRSIMKELFEFSPQEEIVVEGNTWLLSSDFVYTAIRDTET
IPD079Et   (51)   SYDAFGFFANPRSIMKELFEFSPQEEIVVEGNTWLLSSDFVYTAIRDTET
IPD079Eu   (51)   SYDAFGFFANPRSIMKELFEFSPQEEIVVEGNTWLLSSDFVYTAIRDTET
IPD079Ev   (51)   SYDAFGFFANPRSIMKELFEFSPQEEIVVEGNTWLLSSDFVYTAIRDTET
IPD079Ew   (51)   SYDAFGFFANPRSIMKELFEFSPQEEIVVEGNTWLLSSDFVYTAIRDTET
IPD079Ey   (51)   SYDAFGFFANPRSIMKELFEFSPQEEIVVEGNTWLLSSDFVYTAIRDTET
IPD079Ex   (51)   SYDAFGFFANPRSIMKELFEFSPQEEIVVEGNTWLLSSDFVYTAIRDTET
IPD079Ez   (51)   SYDAFGFFANPRSIMKELFEFSPQEEIVVEGNTWLLSSDFVYTAIRDTET
IPD079Fa   (51)   SYDAFGYFANPRSIMKELFQFSPQKEIVVEGNTWLLSSDFVYTAIRDTET
```

Fig. 2C

```
                  101                                                  150
IPD079Ea   (101)  STVSRRTKDDYSKELAVKVKLSGSYGYFSASVESDFSQSISDATDTTYTS
IPD079Eaa  (101)  STVSRRTKDDYSKELAVKVKLSGSYGFFSASVESDFSQSISDVTDTTYTS
IPD079Eab  (101)  STVSRRTKDDYSKELAVKVKLSGSYGFFSASVESDFSQSISDVTDTTYTS
IPD079Eac  (101)  FTLSHRTKDDYSKELALKVKLSGSYGFFSASVESDFSQSISDVTDTTYTS
IPD079Ead  (101)  STVSRRTKDDYSKELAVKVKLSGSYGYFSASVESDFSQSISDATDTTYTS
IPD079Eae  (101)  STVSRRTKDDYSKELAVKVKLSGSYGYFSASVESDFSQSISDATDTTYTS
IPD079Eb   (101)  STVSRRTKDDYSKELAVKVKLSGSYGYFSASVESDFSQSISDATDTTYTS
IPD079Ec   (101)  STVSRRTKDDYSKELAVKVKLSGSYGYFSASVESDFSQSISDVTDTTYTS
IPD079Ed   (101)  STVSRRTKDDYSKELAVKVKLSGSYGYFSASVESDFSQSISDATDTTYTS
IPD079Ee   (101)  FTLSHRTKDDYSKELALKVKLSGSYGFFSASVESDFSQSISDVTDTTYTS
IPD079Ef   (101)  STVSRRTKDDYSKELAVKVKLSGSYGYFSASVESDFSQSISDATDTTYTS
IPD079Eg   (101)  FTLSHRTKDDYSKELALKVKLSGSYGFFSASVESDFSQSISDVTDTTYTS
IPD079Eh   (101)  STVSRRTKDDYSKELAVKVKLSGSYGYFSASVESDFSQSISDATDTTYTS
IPD079Ei   (101)  STVSRRTKDDYSKELAVKVKLSGSYGYFSASVESDFSQSISDATDTTYTS
IPD079Ej   (101)  STVSRRTKDDYSKELAVKVKLSGSYGYFSASVESDFSQSISDATDTTYTS
IPD079Ek   (101)  STVSRRTKDDYSKELAVKVKLSGSYGFFSASVESDFSQSISDATDTTYTS
IPD079El   (101)  STVSRRTKDDYSKELAVKVKLSGSYGFFSASVESDFSQSISDVTDTTYTS
IPD079Em   (101)  STVSRRTKDDYSKELAVKVKLSGSYGYFSASVESDFSQSISDATDTTYTS
IPD079En   (101)  STVSRRTKDDYSKELALKVKLSGSYGFFSASVESDFSQSISDVTDTTYTS
IPD079Eo   (101)  STVSRRTKDDYSKELAVKVKLSGSYGYFSASVESDFSQSISDATDTTYTS
IPD079Ep   (101)  STVSRRTKDDYSKELAVKVKLSGSYGYFSASVESDFSQSISDATDTTYTS
IPD079Eq   (101)  STVSRRTKDDYSKELAVKVKLSGSYGFFSASVESDFSQSISDVTDTTYTS
IPD079Er   (101)  STVSRRTKDDYSKELAVKVKLSGSYGYFSASVESDFSQSISDATDTTYTS
IPD079Es   (101)  STVSRRTKDDYSKELAVKVKLSGSYGYFSASVESDFSQSISDATDTTYTS
IPD079Et   (101)  STVSRRTKDDYSKELAVKVKLSGSYGFFSASVESDFSQSISDATDTTYTS
IPD079Eu   (101)  STVSRRTKDDYSKELAVKVKLSGSYGYFSASVESDFSQSISDATDTTYTS
IPD079Ev   (101)  STVSRRTKDDYSKELAVKVKLSGSYGFFSASVESDFSQSISDVTDTTYTS
IPD079Ew   (101)  STVSRRTKDDYSKELAVKVKLSGSYGFFSASVESDFSQSISDVTDTTYTS
IPD079Ey   (101)  STVSRRTKDDYSKELAVKVKLSGSYGYFSASVESDFSQSISDATDTTYTS
IPD079Ex   (101)  STVSRRTKDDYSKELAVKVKLSGSYGFFSASVESDFSQSISDVTDTTYTS
IPD079Ez   (101)  STVSRRTKDDYSKELAVKVKLSGSYGFFSASVESDFSQSISDVTDTTYTS
IPD079Fa   (101)  FTVSHRTKDDYSTELALKVKLSGSYGIFSASVQSDFSQSISDVTDTTYTS
```

Fig. 2D

```
                      151                                                200
IPD079Ea   (151)  VRTHVNKWRLSLKDDVGALRSKLLPGVKQALATMDATQLFDTFGTHYVSE
IPD079Eaa  (151)  VRTHVNKWRLSLKDDVGALRSKLLPGFKQALATMDATQLFDTFGTHYVSE
IPD079Eab  (151)  VRTHVNKWRLSLKDDVGALRSKLLPGFKQALATMDATQLFDTFGTHYVSE
IPD079Eac  (151)  VRTHVNKWRLSLKDDVGALRSKLLPGFKQALATMDATQLFDTFGTHYVSE
IPD079Ead  (151)  VRTHVNKWRLSLKDDVGALRSKLLPGVKQALATMDATQLFDTFGTHYVSE
IPD079Eae  (151)  VRTHVNKWRLSLKDDVGALRSKLLPGVKQALATMDATQLFDTFGTHYVSE
IPD079Eb   (151)  VRTHVNKWRLSLKDDVGALRSKLLPGVKQALATMDATQLFDTFGTHYVSE
IPD079Ec   (151)  VRTHVNKWRLSLKDDVGALRSKLLPGVKQALATMDATQLFDTFGTHYVSE
IPD079Ed   (151)  VRTHVNKWRLSLKDDVGALRSKLLPGVKQALATMDATQLFDTFGTHYVSE
IPD079Ee   (151)  VRTHVNKWRLSLKDDVGALRSKLLPGFKQALATMDATQLFDTFGTHYVSE
IPD079Ef   (151)  VRTHVNKWRLSLKDDVGALRSKLLPGVKQALATMDATQLFDTFGTHCVSE
IPD079Eg   (151)  VRTHVNKWRLSLKDDVGALRSKLLPGFKQALATMDATQLFDTFGTHYVSE
IPD079Eh   (151)  VRTHVNKWRLSLKDDVGALRSKLLPGVKQALATMDATQLFDTFGTHYVSE
IPD079Ei   (151)  VRTHVNKWRLSLKDDVGALRSKLLPGVKQALATMDATQLFDTFGTHYVSE
IPD079Ej   (151)  VRTHVNKWRLSLKDDVGALRSKLLPGFKQALATMDATQLFDTFGTHYVSE
IPD079Ek   (151)  VRTHVNKWRLSLKDDVGALRSKLLPGVKQALATMDATQLFDTFGTHYVSE
IPD079El   (151)  VRTHVNKWRLSLKDDVGALRSKLLPGFKQALATMDATQLFDTFGTHYVSE
IPD079Em   (151)  VRTHVNKWRLSLKDDVGALRSKLLPGVKQALATMDATQLFDTFGTHYVSE
IPD079En   (151)  VRTHVNKWRLSLKDDVGALRSKLLPGFKQALATMDATQLFDTFGTHYVSE
IPD079Eo   (151)  VRTHVNKWRLSLKDDVGALRSKLLPGFKQALATMDATQLFDTFGTHYVSE
IPD079Ep   (151)  VRTHVNKWRLSLKDDVGALRSKLLPGVKQALATMDATQLFDTFGTHYVSE
IPD079Eq   (151)  VRTHVNKWRLSLKDDVGALRSKLLPGFKQALATMDATQLFDTFGTHYVSE
IPD079Er   (151)  VRTHVNKWRLSLKDDVGALRSKLLPGFKQALATMDATQLFDTFGTHYVSE
IPD079Es   (151)  VRTHVNKWRLSLKDDVGALRSKLLPGFKQALATMDATQLFDTFGTHYVSE
IPD079Et   (151)  VRTHVNKWRLSLKDDVGALRSKLLPGVKQALATMDATQLFDTFGTHYVSE
IPD079Eu   (151)  VRTHVNKWRLSLKDDVGALRSKLLPGVKQALATMDATQLFDTFGTHYVSE
IPD079Ev   (151)  VRTHVNKWRLSLKDDVGALRSKLLPGFKQALATMDATQLFDTFGTHYVSE
IPD079Ew   (151)  VRTHVNKWRLSLKDDVGALRSKLLPGFKQALATMDATQLFDTFGTHYVSE
IPD079Ey   (151)  VRTHVNKWRLSLKDDVGALRSKLLPGFKQALATMDATQLFDTFGTHYVSE
IPD079Ex   (151)  VRTHVNKWRLSLKDDVGALRSKLLPGFKQALATMDATQLFDTFGTHYVSE
IPD079Ez   (151)  VRTHVNKWRLSLKDDVGALRSKLLPGFKQALATMDATQLFDTFGTHYVSE
IPD079Fa   (151)  VNTNVNKWRLSLKDNVGALRAKLLPDFKQALATMDATPLFDTYGTHYVSE
```

Fig. 2E

```
              201                                                250
IPD079Ea  (201) VLVGGRADYVATTKTSAFSSSTSISVAAEASFQSIAGGEVSPESKVLAEM
IPD079Eaa (201) VLVGGRADYVATTKTSAFSSSTSISVAAEASFQSIAGGEVSPESKVLAET
IPD079Eab (201) VLVGGRADYVATTKTSAFSSSTSISVAAEASFQSIAGGEVSPESKVLAET
IPD079Eac (201) VLVGGRADYVATTKTSAFSSSTSISVAAEASFQSIAGGEVSPESKVLAEM
IPD079Ead (201) VLVGGRADYVATTKTSAFSSSTNISAVAEASFKSIAGGEVSPEYKELVQT
IPD079Eae (201) VLVGGRADYVATTKTSAFSSSTSISVAAEASFQSIAGGEVSPESKVLAEM
IPD079Eb  (201) VLVGGRADYVATTKTSAFSSSTSISVAAEASFQSIAGGEVSPESKVLAEM
IPD079Ec  (201) VLVGGRADYVATTKTSAFSSSTSISVAAEASFQSIAGGEVSPESKVLAET
IPD079Ed  (201) VLVGGRADYVATTKTSAFSSSTSISVAAEASFQSIAGGEVSPESKVLAEM
IPD079Ee  (201) VLVGGRADYVATTKTSAFSSSTSISVAAEASFKSIAGGEVSPESKELAET
IPD079Ef  (201) VLVGGRADYVATTKTSAFSSSTSISVAAEASFQSIAGGEVSPESKVLAEM
IPD079Eg  (201) VLVGGRADYVATTKTSAFSSSTSISVAAEASFKSIAGGEVSPESKELAET
IPD079Eh  (201) VLVGGRADYVATTKTSAFSSSTSISVAAEASFQSIAGGEVSPESKVLAEM
IPD079Ei  (201) VLVGGRADYVATTKTSAFSSSTSISVAAEASFQSIAGGEVSPESKVLAEM
IPD079Ej  (201) VLVGGRADYVATTKTSAFSSSTSISVAAEASFQSIAGGEVSPESKVLAEM
IPD079Ek  (201) VLVGGRADYVATTKTSAFSSSTSISVAAEASFQSIAGGEVSPESKVLAEM
IPD079El  (201) VLVGGRADYVATTKTSAFSSSTSISVAAEASFQSIAGGEVSPESKELAET
IPD079Em  (201) VLVGGRADYVATTKTSAFSSSTSISVAAEASFQSIAGGEVSPESKVLAEM
IPD079En  (201) VLVGGRADYVATTKTSAFSSSTSISVAAEASFQSIAGGEVSPESKVLAET
IPD079Eo  (201) VLVGGRANYVATTKTSAFSSSTSISVAAEASFQSIAGGEVSPESKVLAET
IPD079Ep  (201) VLVGGHADYVATTKTSAFSSSTSISVAAEASFQSIAGGEVSPESKVLAET
IPD079Eq  (201) VLVGGRADYVATTKTSAFSSSTSISVAAEASFQSIAGGEVSPESKVLAET
IPD079Er  (201) VLVGGRADYVATTKTSAFSSSTSISVAAEASFQSIAGGEVSPESKVLAET
IPD079Es  (201) VLVGGRADYVATTKTSAFSSSTSISVAAEASFQSIAGGEVSPESKVLAET
IPD079Et  (201) VLVGGRADYVATTKTSAFSSSTSISVAAEASFQSIAGGEVSPESKVLAET
IPD079Eu  (201) VLVGGRADYVATTKTSAFSSSTSISVAAEASFQSIAGGEVSPESKVLAET
IPD079Ev  (201) VLVGGRADYVATTKTSAFSSSTSISVAAEASFQSIAGGEVSPESKVLAEM
IPD079Ew  (201) VLVGGRADYVATTKTSAFSSSTSISVAAEASFQSIAGGEVSPESKELAET
IPD079Ey  (201) VLVGGRADYVATTKTSAFSSSTSISVAAEASFQSIAGGEVSPASKVLAEM
IPD079Ex  (201) VLVGGRADYVATTKTSAFSSPSISVAAEASFQSIAGGEVSPESKVLAET
IPD079Ez  (201) VLVGGRADYVATTKTSAFSSSTSISVAAEASFQSIAGGEVSPESKVLAET
IPD079Fa  (201) VLVGGRADYVATTKTSAFSSSTNISAVAEASFNSIAGGEVSAEYKELVQT
```

Fig. 2F

```
                    251                                                            300
IPD079Ea   (251)    LRENSSTRLYALGGSALPNITDPATYNAWLESIDTIPVFCGFTQNSLKSI
IPD079Eaa  (251)    LRENSSTRLYALGGSALPNITDPATYNAWLQSIDTIPVFCGFTQNSLKPI
IPD079Eab  (251)    LRENSSTRLYALGGSALPNITDPATYNAWLKSIDTIPVFCGFTQNSLKPI
IPD079Eac  (251)    LRENSSTRLYALGGSALPNITDPATYNAWLESIDTIPVFCGFTQNSLKPI
IPD079Ead  (251)    LRENSSTRLYALGGSALSNITDSATYNAWLKSIDTIPVFCGFTQNSLKPI
IPD079Eae  (251)    LRENSSTRLYALGGSALPNITDSSTYNAWLKSIDTIPVFCGFTLNSLKPI
IPD079Eb   (251)    LRENSSTRLYALGGSALPNITDPATYNAWLESIDTIPVFCGFTQNSLKPI
IPD079Ec   (251)    LRENSSTRLYALGGSALPNITDPATYNAWLESIDTIPVXCGFTQNSLKPI
IPD079Ed   (251)    LRENSSTRLYALGGSALPNITDPATYNAWLESIDTIPVFCGFTQNSLKPI
IPD079Ee   (251)    LRENSSTRLYALGGSALTNITDPAXYNAWLQSIDTIPVXCGFTQNSLKPI
IPD079Ef   (251)    LRENSSTRLYALGGSALPNITDPATYNAWLESIDTIPVFCGFTQNSLKPI
IPD079Eg   (251)    LRENSSTRLYALGGSALTNITDPATYNAWLQSIDTIPVFCGFTQNSLKPI
IPD079Eh   (251)    LRENSSTRLYALGGSALPNITDPVTYNAWLESIDTIPVFCGFTQNSLKPI
IPD079Ei   (251)    LRENSSTRLYALGGSALPNITDPATYNAWLESIDTIPVFCGFTQNSLKPI
IPD079Ej   (251)    LRENSSTRLYALGGSALPNITDPATYNAWLESIDTIPVFCGFTQNSLKPI
IPD079Ek   (251)    LRENSSTRLYALGGSALPNITDPATYNAWLESIDTIPVFCGFTQNSLKPI
IPD079El   (251)    LRENSSTRLYALGGSALPNITDPATYNAWLESIDTIPVFCGFTQNSLKPI
IPD079Em   (251)    LRENSSTRLYALGGSALPNITDPATYNAWLQSIDTIPVFCGFTQNSLKPI
IPD079En   (251)    LRENSSTRLYALGGSALPNITDPATYNAWLESIDTIPVFCGFTQNSLKPI
IPD079Eo   (251)    LRENSSTRLYALGGSALPNITDPATYNAWLESIDTIPVFCGFTQNSLKPI
IPD079Ep   (251)    LRENSSTRLYALGGSALPNITDPATYNAWLQSIDTIPVFCGFTQNSLKPI
IPD079Eq   (251)    LRENSSTRLYALGGSALPNITDPATYNAWLQSIDTIPVFCGFTQNSLKPI
IPD079Er   (251)    LRENSSTRLYALGGSALPNITDPATYNAWLESIDTIPVFCGFTQNSLKPI
IPD079Es   (251)    LRENSSTRLYALGGSALPNITDPATYNAWLESIDTIPVFCGFTQNSLKPI
IPD079Et   (251)    LRENSSTRLYALGGSALPNITDPATYNAWLQSIDTIPVFCGFTQNSLKPI
IPD079Eu   (251)    LRENSSTRLYALGGSALPNITDPATYNAWLQSIDTIPVFCGFTQNSLKPI
IPD079Ev   (251)    LRENSSTRLYALGGSALPNITDPATYNAWLESIDTIPVFCGFTQNSLKPI
IPD079Ew   (251)    LRENSSTRLYALGGSALPNITDPATYNAWLESIDTIPVFCGFTQNSLKPI
IPD079Ey   (251)    LRENSSTRLYALGVSALPNITDPATYNAWLESIDTIPVFCGFTQNSLKPI
IPD079Ex   (251)    LRENSSTRLYALGGSALPNITDPATYNAWLQSIDTIPVFCGFTQNSLKPI
IPD079Ez   (251)    LRENSSTRLYALGGSALPNITDPATYNAWLQSIDTIPVFCGFTQNSLKPI
IPD079Fa   (251)    LRENSSTRLYALGGSALSNITDSATYNAWLKSIDTIPVFCGFTLNSLNPI
```

Fig. 2G

```
                     301                                                      350
IPD079Ea   (301)  SELADSAQRRDALAKASQSYIPSYVTRPAVVGLEVIISDSNSESPPYGYT
IPD079Eaa  (301)  SELADSAQRRDALAKASQSYIPSYATRPAVVGLEVIISDSNSESPPYGYT
IPD079Eab  (301)  SELADSAQRRDALAKASQSYIPSYVTRPAVVGLEVIISDSNSESPPYGYT
IPD079Eac  (301)  SELADSAQRRDALAKASQSYIPSYVTRPAVVGLEVIISDSNSESPPYGYT
IPD079Ead  (301)  SELADSAQRRDALAKASQSYIPSYVTRPAVVGLEVIISDSNSESPPYGYT
IPD079Eae  (301)  SELANSAQRRDALAKASQSYIPSYVTRPAVVGLEVIISDSYWESPPYGYT
IPD079Eb   (301)  SELADSAQRRDALAKASQSYIPSYVTRPAVVGLEVIISDSNSESPPYGYT
IPD079Ec   (301)  SELADSAQRRDALAKASQSYIPSYVTRPAVVGLEVIISDSNSESPPYGYT
IPD079Ed   (301)  SELADSAQRRDALAKASQSYIPSYVTRPAVVGLEVIISDSNSESPPYGYT
IPD079Ee   (301)  SELADSAQRRDALAKASQSYIPSYVTRPAVVGLEVIISDSNSESPPYGYT
IPD079Ef   (301)  SELADSAQRRDALAKASQSYIPSYVTRPAVVGLEVIISDSNSESPPYGYT
IPD079Eg   (301)  SELADSAQRRDALAKASQSYIPSYVTRPAVVGLEVIISDSNSESPPYGYT
IPD079Eh   (301)  SELADSAQRRDALAKASQSYIPSYVTRPAVVGLEVIISDSNSESPPYGYT
IPD079Ei   (301)  SELADSAQRRDALAKASQSYIPSYVTRPAVVGLEVIISDSNSESPPYGYT
IPD079Ej   (301)  SELADSAQRRDALAKASQSYIPSYVTRPAVVGLEVIISDSNSESPPYGYT
IPD079Ek   (301)  SELADSAQRRDALAKASQSYIPSYVTRPAVVGLEVIISDSNSESPPYGYT
IPD079El   (301)  SELADSAQRRDALAKASQSYIPSYVTRPAVVGLEVIISDSNSESPPYGYT
IPD079Em   (301)  SELADSCQRRDALAKASQSYIPSYVTRPAVVGLEVIISDSNSESPPYGYT
IPD079En   (301)  SELADSAQRRDALAKASQSYIPSYVTRPAVVGLEVIISDSNSESPPYGYT
IPD079Eo   (301)  SELADSAQRRDALAKASQSYIPSYVTRPAVVGLEVIISDSNSESPPYGYT
IPD079Ep   (301)  SELADSAQRRDALAKASQSYIPSYVTRPAVVGLEVIISDSNSESPPYGYT
IPD079Eq   (301)  SELADSAQRRDALAKASQSYIPSYVTRPAVVGLEVIISDSNSESPPYGYT
IPD079Er   (301)  SELADSAQRRDALAKASQSYIPSYVTRPAVVGLEVIISDSNSESPPYGYT
IPD079Es   (301)  SELADSAQRRDALAKASQSYIPSYVTRPAVVGLEVIISDSNSESPPYGYT
IPD079Et   (301)  SELADSAQRRDALAKASQSYIPSYATRPAVVGLEVIISDSNSESPPYGYT
IPD079Eu   (301)  SELADSAQRRDALAKASQSYIPSYVTRPAVVGLEVIISDSNSESPPYGYT
IPD079Ev   (301)  SELADSAQRRDALAKASQSYIPSYVTRPAVVGLEVIISDSNSESPPYGYT
IPD079Ew   (301)  SELADSAQRRDALAKASQSYIPSYVTRPAVVGLEVIISDSNSESPPYGYT
IPD079Ey   (301)  SELADSAQRRVALAKASQSYIPSYVTRPAVVGLEVIISDSNSESPPYGYT
IPD079Ex   (301)  SELADSAQRRDALAKASQSYIPSYVTRPAVVGLEVIISDSNSESPPYGYT
IPD079Ez   (301)  SELADSAQRRDALAKASQSYIPSYVTRPAVVGLEVIISDSNSESPPYGYT
IPD079Fa   (301)  SELADSAQRRDALAKASQSYIPSYVTRPAVVGLEVIISDSYWENPPYGYT
```

Fig. 2H

```
              351                                                    400
IPD079Ea  (351) RIDYDLNRNAGGKYVFLCYKQKNISVGGDADAITDVLVVYGNDRNPSVPS
IPD079Eaa (351) RIDYDLNRNAGGKYVFLCYKQKNISVGGDADAITDVLVVYGNDRNPSVPS
IPD079Eab (351) RIDYDLNRNAGGKYVFLCYKQKYISVGGDADAITDVLVVYGNDRNPSVPS
IPD079Eac (351) RIDYDLNRNAGGKYVFLCYKQKNISVGGDADAITDVLVVYGNDRNPSVPS
IPD079Ead (351) RIDYDLNRNAGGKYVFLCYKQKNISVGGDADAITDVLVVYGNDRNPSVPY
IPD079Eae (351) KINYDLNRNAGGKYVFLCYKQKNISVGRDADTITDVHVIYGDGPNPSVPY
IPD079Eb  (351) RIDYDLNRNAGGKYVFLCYKQKNISVGGDADAITDVLVVYGNDRNPSVPS
IPD079Ec  (351) RIDYDLNRNAGGKYVFLCYKQKNISVGGDADAITDVLVVYGNDRNPSVPS
IPD079Ed  (351) RIDYDLNRNAGGKYVFLCYKQKNISVGGDADAITDVLVVYGNDRNPSVPS
IPD079Ee  (351) RIDYDLNRNAGGKYVFLCYKQKYISVGGDADAITDVLVVYGNDRNPSVPS
IPD079Ef  (351) RIDYDLNRNAGGKYVFLCYKQKNISVGGDADAITDVLVVYGNDRNPSVPS
IPD079Eg  (351) RIDYDLNRNAGGKYVFLCYKQKNISVGGDADAITDVLVVYGNDRNPSVPS
IPD079Eh  (351) RIDYDLNRNAGGKYVFLCYKQKNISVGGDADAITDVLVVYGNDRNPSVPS
IPD079Ei  (351) RIDYDLNRNAGGKYVFLCYKQKNISVGGDADAITDVLVVYGNDRNPSVPS
IPD079Ej  (351) RIDYDLNRNAGGKYVFLCYKQKNISVGGDADAITDVLVVYGNDRNPSVPS
IPD079Ek  (351) RIDYDLNRNAGGKYVFLCYKQKNISVGGDADAITDVLVVYGNDRNPSVPS
IPD079El  (351) RIDYDLNRNAGGKYVFLCYKQKNISVGGDADAITDVLVVYGNDRNPSVPS
IPD079Em  (351) RIDYDLNRNAGGKYVFLCYKQKNISVGGDADAITDVLVVYGNDRNPSVPS
IPD079En  (351) RIDYDLNRNAGGKYVFLCYKQKNISVGGDADAITDVLVVYGNDRNPSVPS
IPD079Eo  (351) RIDYDLNRNAGGKYVFLCYKQKNISVGGDADAITDVLVVYGNDRNPSVPS
IPD079Ep  (351) RIDYDLNRNAGGKYVFLCYKQKNISVGGDADAITDVLVVYGNDRNPSVPS
IPD079Eq  (351) RIDYDLNRNAGGKYVFLCYKQKNISVGGDADAITDVLVVYGNDRNPSVPS
IPD079Er  (351) RIDYDLNRNAGGKYVFLCYKQKNISVGGDADAITDVLVVYGNDRNPSVPS
IPD079Es  (351) RIDYDLNRNAGGKYVFLCYKQKNISVGGDADAITDVLVVYGNDRNPSVPS
IPD079Et  (351) RIDYDLNRNAGGKYVFLCYKQKNISVGGDADAITDVLVVYGNDRNPSVPS
IPD079Eu  (351) RIDYDLNRNAGGKYVFLCYKQKNISVGGDADAITDVLVVYGNDRNPSVPS
IPD079Ev  (351) RIDYDLNRNAGGKYVFLCYKQKNISVGGDADAITDVLVVYGNDRNPSVPS
IPD079Ew  (351) RIDYDLNRNAGGKYVFLCYKQKNISVGGDADAITDVLVVYGNDRNPSVPS
IPD079Ey  (351) RIDYDLNRNAGGKYVFLCYKQKNISVGGDADAITDVLVVYGNDRNPSVPS
IPD079Ex  (351) RIDYDLNRNAGGKYVFLCYKQKNISVGGDADAITDVLVVYGNDRNPSVPS
IPD079Ez  (351) RIDYDLNRNAGGKYVFLCYKQKNISVGGDADAITDVLVVYGNDRNPSVPS
IPD079Fa  (351) KINYDLNRNAGGQYVFLCYKQKNISVGGDADAITDVHVVYGDGPNPSVPS
```

Fig. 2I

```
                401                                                    450
IPD079Ea   (401) GYTKIDKDLNSGAGGKYIYFCYSKDKRKQEEGLPIRGLRVVGPHPTSVAP
IPD079Eaa  (401) GYTKIDKDLNSGAGGKYIYFCYSKDKRKQEEGLPIRGLRVVGPHPTSVAP
IPD079Eab  (401) GYTKIDKDLNSGAGGKYIYICYSKDKWKQEEGLPIRGLRVVGPDANSVAP
IPD079Eac  (401) GYTKIYKDLNSGAGGKYIYFCYSKDKRKQEEGLPIRGLRVVGPHPTSVAP
IPD079Ead  (401) GYTKIDKDLNCGAGGKYIYICYSKDKWRQEEGLPIRGLRVVGPDPNSVAP
IPD079Eae  (401) GYTKIDKDLNCGAGGKYIYICYSKDKWRQEEGLPIRGLRVVGPHPTSVAP
IPD079Eb   (401) GYTKIDKDLNSGAGGKYIYFCYSKDKRKQEEGLPIRGLRVVGPHPTSVAP
IPD079Ec   (401) GYTKIDKDLNSGAGGKYIYFCYSKDKRKQEEGLPIRGLRVVGPHPTSVAP
IPD079Ed   (401) GYTKIDKDLNSGAGGKYIYFCYSKDKRKQEEGLPIRGLRVVGPHPTSVAP
IPD079Ee   (401) GYTKIDKDLNSGAGGKYIYFCYSKDKHKQEEGLPIRGLRVVGPHPTSVAP
IPD079Ef   (401) GYTKIDKDLNSGAGGKYIYFCYSKDKRKQEEGLPIRGLRVVGPHPTSVAP
IPD079Eg   (401) GYTKIDKDLNSGAGGKYIYFCYSKDKRKQEEGLPIRGLRVVGPHPTSVAP
IPD079Eh   (401) GYTKIDKDLNSGAGGKYIYFCYSKDKRKQEEGLPIRGLRVVGPHPTSVAP
IPD079Ei   (401) GYTKIDKDLNSGAGGKYIYFCYSKDKRKQEEGLPIRGLRVVGPHPTSVAP
IPD079Ej   (401) GYTKIDKDLNSGAGGKYIYFCYSKDKRKQEEGLPIRGLRVVGPHPTSVAP
IPD079Ek   (401) GYTKIDKDLNSGAGGKYIYFCYSKDKRKQEEGLPIRGLRVVGPHPTSVAP
IPD079El   (401) GYTKIDKDLNSGAGGKYIYFCYSKDKRKQEEGLPIRGLRVVGPHPTSVAP
IPD079Em   (401) GYTKIDKDLNSGAGGKYIYFCYSKDKRKQEEGLPIRGLRVVGPHPTSVAP
IPD079En   (401) GYTKIDKDLNSGAGGKYIYFCYSKDKRKQEEGLPIRGLRVVGPHPTSVAP
IPD079Eo   (401) GYTKIDKDLNSGAGGKYIYFCYSKDKRKQEEGLPIRGLRVVGPHPTSVAP
IPD079Ep   (401) GYTKIDKDLNSGAGGKYIYFCYSKDKRKQEEGLPIRGLRVVGPHPTSVAP
IPD079Eq   (401) GYTKIDKDLNSGAGGKYIYFCYSKDKRKQEEGLPIRGLRVVGPHPTSVAP
IPD079Er   (401) GYTKIDKDLNSGAGGKYIYFCYSKDKRKQEEGLPIRGLRVVGPHPTSVAP
IPD079Es   (401) GYTKIDKDLNSGAGGKYIYFCYSKDKRKQEEGLPIRGLRVVGPHPTSVAP
IPD079Et   (401) GYTKIDKDLNSGAGGKYIYFCYSKDKRKQEEGLPIRGLRVVGPHPTSVAP
IPD079Eu   (401) GYTKIDKDLNSGAGGKYIYFCYSKDKRKQEEGLPIRGLRVVGPHPTSVAP
IPD079Ev   (401) GYTKIDKDLNSGAGGKYIYFCYSKDKRKQEEGLPIRGLRVVGPHPTSVAP
IPD079Ew   (401) GYTKIDKDLNSGAGGKYIYFCYSKDKRKQEEGLPIRGLRVVGPHPTSVAP
IPD079Ey   (401) GYTKIDKDLNSGAGGKYIYFCYSKDKRKQEEGPPIRGLRVVGPHPTSVAP
IPD079Ex   (401) GYTKIDKDLNSGAGGKYIYFCYSKDKRKQEEGLPIRGLRVVGPHPTSVAP
IPD079Ez   (401) GYTKIDKDLNSGAGGKYIYFCYSKDKRKQEEGLPIRGLRVVGPHSTSVAP
IPD079Fa   (401) GYTKIDKDLNCGAGGKYIYICYSKDKWKQEEGLPIRGLRVVGPDANSVAP
```

Fig. 2J

```
                      451                           479
IPD079Ea    (451)  YGFSKIDIDLNMGAGGDFIYLCKSRHLE
IPD079Eaa   (451)  YGFSKIDIDLNMGAGGDFIYLCKSRHLE
IPD079Eab   (451)  YGFSKIDIDLNMDAGGDFIYLCKSRHLE
IPD079Eac   (451)  YGFSKIDIDLNMGAGGDFIYLCKSRHLE
IPD079Ead   (451)  YGFSKIDIDLNMGAGGDFIYLCKSRHLE
IPD079Eae   (451)  YGFSKIDIDLNMGAGGDFIYLCKSRHLE
 IPD079Eb   (451)  YGFSKIDIDLNMGAGGDFIYLCKSRHLE
 IPD079Ec   (451)  Y---------------------------
 IPD079Ed   (451)  YGFSKIDIDLNMGAGGDFIYLCKSRHLE
 IPD079Ee   (451)  YGFSKIDIDLNMGAGGDFIYLCKSRHLE
 IPD079Ef   (451)  YGFSKIDIDLNMGAGGDFIYLCKSRHLE
 IPD079Eg   (451)  YGFSKIDIDLNMGAGGDFIYLCKSRHLE
 IPD079Eh   (451)  YGFSKIDIDLNMGAGGDFIYLCKSRHLE
 IPD079Ei   (451)  YGFSKIDIDLNMGAGGDFIYLCKSRHLE
 IPD079Ej   (451)  YGFSKIDIDLNMGAGGDFIYLCKSRHLE
 IPD079Ek   (451)  YGFSKIDIDLNMGAGGDFIYLCKSRHLE
 IPD079El   (451)  YGFSKIDIDLNMGAGGDFIYLCKSRHLE
 IPD079Em   (451)  YGFSKIDIDLNMGAGGDFIYLCKSRHLE
 IPD079En   (451)  YGFSKIDIDLNMGAGGDFIYLCKSRHLE
 IPD079Eo   (451)  YGFSKIDIDLNMGAGGDFIYLCKSRHLE
 IPD079Ep   (451)  YGFSKIDIDLNMGAGGDFIYLCKSRHLE
 IPD079Eq   (451)  YGFSKIDIDLNMGAGGDFIYLCKSRHLE
 IPD079Er   (451)  YGFSKIDIDLNMGAGGDFIYLCKSRHLE
 IPD079Es   (451)  YGFSKIDIDLNMGAGGDFIYLCKSRHLE
 IPD079Et   (451)  YGFSKIDIDLNMGAGGDFIYLCKSRHLE
 IPD079Eu   (451)  YGFSKIDIDLNMGAGGDFIYLCKSRHLE
 IPD079Ev   (451)  YGFSKIDIDLNMGAGGDFIYLCKSRHLE
 IPD079Ew   (451)  YGFSKIDIDLNMGAGGDFIYLCKSRHLS
 IPD079Ey   (451)  YGFSKIDIDLNMGAGGDFIYLCKSRHLE
 IPD079Ex   (451)  YGFSKIDIDLNMGAGGDFIYLCKSRHLE
 IPD079Ez   (451)  YGFSKIDIDLNMGAGGDFIYLCKSRHLE
 IPD079Fa   (451)  YGFSKIDIDLNMDAGGDFIYLCKSRHLE
```

Fig. 6A

```
                     1                                                50
   IPD079Aa    (1)   ------------------------------------MAQIEPLPGSDAIGL
  79Chimera1   (1)   ------------------------------------MAQIEPLPGSDAIGL
  79Chimera2   (1)   MEPNKGGAPAMKNVAKPSTKRLIPSSIAASSQTSANALTEPLPGSDAIGQ
  79Chimera3   (1)   MEPNKGGAPAMKNVAKPSTKRLIPSSIAASSQTSANALTEPLPGSDAIGQ
   IPD079Ea    (1)   MEPNKGGAPAMKNVAKPSTKRLIPSSIAASSQTSANALTEPLPGSDAIGQ 51                                               100
   IPD079Aa   (16)   SYDVFGFYANPKSVNRQLFDFAPQQEITLEDHTWLLSTDIVYIAVRDTDI
  79Chimera1  (16)   SYDVFGFYANPKSVNRQLFDFAPQQEITLEDHTWLLSTDIVYIAVRDTDI
  79Chimera2  (51)   SYDAFGFFANPRSIMKELFEFSPQEEIVVEGNTWLLSSDFVYTAIRDTET
  79Chimera3  (51)   SYDAFGFFANPRSIMKELFEFSPQEEIVVEGNTWLLSSDFVYTAIRDTET
   IPD079Ea   (51)   SYDAFGFFANPRSIMKELFEFSPQEEIVVEGNTWLLSSDFVYTAIRDTET 101                                              150
   IPD079Aa   (66)   NTVSLRTKDAYSTELAASVKVSGSYGSFSASVESDFSQSISDETDSTYTS
  79Chimera1  (66)   NTVSLRTKDAYSTELAASVKVSGSYGSFSASVESDFSQSISDETDSTYTS
  79Chimera2 (101)   STVSRRTKDDYSKELAVKVKLSGSYGYFSASVESDFSQSISDATDTTYTS
  79Chimera3 (101)   STVSRRTKDDYSKELAVKVKLSGSYGYFSASVESDFSQSISDATDTTYTS
   IPD079Ea  (101)   STVSRRTKDDYSKELAVKVKLSGSYGYFSASVESDFSQSISDATDTTYTS 151                                              200
   IPD079Aa  (116)   VRTNVNKWKLSLKPTVEELRSMLTPSEKEALASMNSEELFTTYGTHYLNE
  79Chimera1 (116)   VRTHVNKWRLSLKDDVGALRSKLLPGVKQALATMDATQLFDTFGTHYVSE
  79Chimera2 (151)   VRTHVNKWRLSLKDDVGALRSKLLPGVKQALATMDATQLFDTFGTHYVSE
  79Chimera3 (151)   VRTHVNKWRLSLKDDVGALRSKLLPGVKQALATMDATQLFDTFGTHYVSE
   IPD079Ea  (151)   VRTHVNKWRLSLKDDVGALRSKLLPGVKQALATMDATQLFDTFGTHYVSE 201                                              250
   IPD079Aa  (166)   VLVGGRADYVATTKTSAFSSDTKISVVAESSFKSVAGMEVSAEYKELIKK
  79Chimera1 (166)   VLVGGRADYVATTKTSAFSSSTSISVAAEASFQSIAGGEVSPESKVLAEM
  79Chimera2 (201)   VLVGGRADYVATTKTSAFSSSTSISVAAEASFQSIAGGEVSPESKVLAEM
  79Chimera3 (201)   VLVGGRADYVATTKTSAFSSSTSISVAAEASFQSIAGGEVSPESKVLAEM
   IPD079Ea  (201)   VLVGGRADYVATTKTSAFSSSTSISVAAEASFQSIAGGEVSPESKVLAEM
```

Fig. 6B

```
              251                                                300
                                         ▼
IPD079Aa   (216) FQENSSTSLYALGGTALSSITDTASYNAWFSSIDTLPVFCGFTYESLQPI
79Chimera1 (216) LRENSSTRLYALGGSALPNITDPATYNAWLESIDTIPVFCGFTQNSLKSI
79Chimera2 (251) LRENSSTRLYALGGSALPNITDPATYNAWLESIDTIPVFCGFTYESLQPI
79Chimera3 (251) LRENSSTRLYALGGSALPNITDPATYNAWLESIDTIPVFCGFTQNSLKSI
IPD079Ea   (251) LRENSSTRLYALGGSALPNITDPATYNAWLESIDTIPVFCGFTQNSLKSI 301                                                350
IPD079Aa   (266) WELAESPQRQEILQKATKTFIPPEIRRNAIVDVDIIVSDNYWVNPPYGYT
79Chimera1 (266) SELADSAQRRDALAKASQSYIPSYVTRPAVVGLEVIISDSNSESPPYGYT
79Chimera2 (301) WELAESPQRQEILQKATKTFIPPEIRRNAIVDVDIIVSDNYWVNPPYGYT
79Chimera3 (301) SELADSAQRRDALAKASQSYIPSYVTRPAVVGLEVIISDSNSESPPYGYT
IPD079Ea   (301) SELADSAQRRDALAKASQSYIPSYVTRPAVVGLEVIISDSNSESPPYGYT 351                                                400
                 ▼
IPD079Aa   (316) KIDYDLNRNAKGKYIFLCYNQQKISVAGSPADPTPITALYVASGDDDHPY
79Chimera1 (316) RIDYDLNRNAGGKYVFLCYKQKNISVGG---DADAITDVLVVYGNDRNPS
79Chimera2 (351) KIDYDLNRNAKGKYIFLCYNQQKISVAGSPADPTPITALYVASGDDDHPY
79Chimera3 (351) RIDYDLNRNAKGKYIFLCYNQQKISVAGSPADPTPITALYVASGDDDHPY
IPD079Ea   (351) RIDYDLNRNAGGKYVFLCYKQKNISVGG---DADAITDVLVVYGNDRNPS 401                                                450
IPD079Aa   (366) VPLGYTRINSDLNEGAGGKYIYLCYTKDPAAIPSDEDGLPIRGIRVIGNE
79Chimera1 (363) VPSGYTKIDKDLNSGAGGKYIYFCYSKDKRKQ---EEGLPIRGLRVVG--
79Chimera2 (401) VPLGYTRINSDLNEGAGGKYIYLCYTKDPAAIPSDEDGLPIRGIRVIGNE
79Chimera3 (401) VPLGYTRINSDLNEGAGGKYIYLCYTKDPAAIPSDEDGLPIRGIRVIGNE
IPD079Ea   (398) VPSGYTKIDKDLNSGAGGKYIYFCYSKDKRKQ---EEGLPIRGLRVVG--

451                      487
IPD079Aa   (416) KVENVVTPYGFTKIDKDLNEGAGGDYIFVCFSRHLD
79Chimera1 (408) PHPTSVAPYGFSKIDIDLNMGAGGDFIYLCKSRHLE
79Chimera2 (451) KVENVVTPYGFTKIDKDLNEGAGGDYIFVCFSRHLD
79Chimera3 (451) KVENVVTPYGFTKIDKDLNEGAGGDYIFVCFSRHLD
IPD079Ea   (443) PHPTSVAPYGFSKIDIDLNMGAGGDFIYLCKSRHLE
```

PLANT DERIVED INSECTICIDAL PROTEINS AND METHODS FOR THEIR USE

CROSS-REFERENCE TO RELATED APPLICATIONS

This application claims priority to U.S. Provisional Application No. 62/201,977, filed Aug. 6, 2015, which is hereby incorporated herein in its entirety by reference.

REFERENCE TO SEQUENCE LISTING SUBMITTED ELECTRONICALLY

The official copy of the sequence listing is submitted electronically via EFS-Web as an ASCII formatted sequence listing with a file named "6472WOPCT_Sequence_Listing" created on Jun. 3, 2016, and having a size of 4,831 kilobytes and is filed concurrently with the specification. The sequence listing contained in this ASCII formatted document is part of the specification and is herein incorporated by reference in its entirety.

FIELD

This disclosure relates to the field of molecular biology. Provided are novel genes that encode pesticidal proteins. These pesticidal proteins and the nucleic acid sequences that encode them are useful in preparing pesticidal formulations and in the production of transgenic pest-resistant plants.

BACKGROUND

Biological control of insect pests of agricultural significance using a microbial agent, such as fungi, bacteria or another species of insect affords an environmentally friendly and commercially attractive alternative to synthetic chemical pesticides. Generally speaking, the use of biopesticides presents a lower risk of pollution and environmental hazards and biopesticides provide greater target specificity than is characteristic of traditional broad-spectrum chemical insecticides. In addition, biopesticides often cost less to produce and thus improve economic yield for a wide variety of crops.

Certain species of microorganisms of the genus *Bacillus* are known to possess pesticidal activity against a range of insect pests including Lepidoptera, Diptera, Coleoptera, Hemiptera and others. *Bacillus thuringiensis* (Bt) and *Bacillus popilliae* are among the most successful biocontrol agents discovered to date. Insect pathogenicity has also been attributed to strains of *B. larvae, B. lentimorbus, B. sphaericus* and *B. cereus*. Microbial insecticides, particularly those obtained from *Bacillus* strains, have played an important role in agriculture as alternatives to chemical pest control.

Crop plants have been developed with enhanced insect resistance by genetically engineering crop plants to produce pesticidal proteins from *Bacillus*. For example, corn and cotton plants have been genetically engineered to produce pesticidal proteins isolated from strains of Bt. These genetically engineered crops are now widely used in agriculture and have provided the farmer with an environmentally friendly alternative to traditional insect-control methods. While they have proven to be very successful commercially, these genetically engineered, insect-resistant crop plants provide resistance to only a narrow range of the economically important insect pests. In some cases, insects can develop resistance to different insecticidal compounds, which raises the need to identify alternative biological control agents for pest control.

Accordingly, there remains a need for new pesticidal proteins with different ranges of insecticidal activity against insect pests, e.g., insecticidal proteins which are active against a variety of insects in the order Lepidoptera and the order Coleoptera including but not limited to insect pests that have developed resistance to existing insecticides.

SUMMARY

In one aspect compositions and methods for conferring pesticidal activity to bacteria, plants, plant cells, tissues and seeds are provided. Compositions include nucleic acid molecules encoding sequences for pesticidal and insecticidal polypeptides, vectors comprising those nucleic acid molecules, and host cells comprising the vectors. Compositions also include the pesticidal polypeptide sequences and antibodies to those polypeptides. The nucleic acid sequences can be used in DNA constructs or expression cassettes for transformation and expression in organisms, including microorganisms and plants. The nucleotide or amino acid sequences may be synthetic sequences that have been designed for expression in an organism including, but not limited to, a microorganism or a plant. Compositions also comprise transformed bacteria, plants, plant cells, tissues and seeds.

In another aspect isolated or recombinant nucleic acid molecules are provided encoding plant derived perforins, including amino acid substitutions, deletions, insertions, fragments, and combinations thereof. In particular, isolated or recombinant nucleic acid molecules are provided encoding IPD079 polypeptides including amino acid substitutions, deletions, insertions, fragments, and combinations thereof. Additionally, amino acid sequences corresponding to the IPD079 polypeptides are encompassed. Provided are isolated or recombinant nucleic acid molecules capable of encoding IPD079 polypeptides of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, and SEQ ID NO: 140, as well as amino acid substitution variants, deletion variants, insertion variants, fragments thereof, and combinations thereof. Nucleic acid sequences that are complementary to a nucleic acid sequence of the embodiments or that hybridize to a sequence of the embodiments are also encompassed.

In another aspect isolated or recombinant IPD079 polypeptides are provided including but not limited to the polypeptides of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, and SEQ ID NO: 140, as well as amino acid substitution variants, deletion variants, insertion variants, fragments thereof, and combinations thereof.

In another aspect methods are provided for producing the polypeptides and for using those polypeptides for controlling or killing a Lepidopteran, Coleopteran, nematode, fungi, and/or Dipteran pests. The transgenic plants of the embodiments express one or more of the pesticidal sequences disclosed herein. In various embodiments, the transgenic plant further comprises one or more additional genes for insect resistance, for example, one or more additional genes for controlling Coleopteran, Lepidopteran, Hemipteran or nematode pests. It will be understood by one of skill in the art that the transgenic plant may also comprise any gene imparting an agronomic trait of interest.

In another aspect methods for detecting the nucleic acids and polypeptides of the embodiments in a sample are also included. A kit for detecting the presence of a plant derived perforin, including but not limited to an IPD079 polypeptide of the disclosure or detecting the presence of a polynucleotide encoding an IPD079 polypeptide in a sample is provided. The kit may be provided along with all reagents and control samples necessary for carrying out a method for detecting the intended agent, as well as instructions for use.

The compositions and methods of the embodiments are useful for the production of organisms with enhanced pest resistance or tolerance. These organisms and compositions comprising the organisms are desirable for agricultural purposes. The compositions of the embodiments are also useful for generating altered or improved proteins that have pesticidal activity or for detecting the presence of IPD079 polypeptides.

BRIEF DESCRIPTION OF THE FIGURES

FIG. 1A-1I shows an amino acid sequence alignment, using the ALIGNX® module of the Vector NTI® suite, of IPD079Aa, (SEQ ID NO: 2), IPD079Ab (SEQ ID NO: 4), IPD079Ac (SEQ ID NO: 6), IPD079Ad (SEQ ID NO: 8), IPD079Ae (SEQ ID NO: 10), IPD079Af (SEQ ID NO: 12), IPD079Ag (SEQ ID NO: 14), IPD079Ah (SEQ ID NO: 16), IPD079Ai (SEQ ID NO: 18), IPD079Aj (SEQ ID NO: 20), IPD079Ak (SEQ ID NO: 22), IPD079Al (SEQ ID NO: 26), IPD079Am (SEQ ID NO: 28), IPD079An (SEQ ID NO: 30), IPD079Ao (SEQ ID NO: 32), IPD079Ap (SEQ ID NO: 36), IPD079Aq (SEQ ID NO: 38), IPD079Ar (SEQ ID NO: 40), IPD079As (SEQ ID NO: 44), IPD079At (SEQ ID NO: 46), IPD079Au (SEQ ID NO: 48), IPD079Av (SEQ ID NO:50), IPD079Aw (SEQ ID NO: 52), IPD079Ax (SEQ ID NO: 54), IPD079Az (SEQ ID NO: 74), IPD079Ba (SEQ ID NO: 24), IPD079Bb (SEQ ID NO:34), IPD079Bc (SEQ ID NO: 42), IPD079Bd (SEQ ID NO: 76), IPD079Be (SEQ ID NO: 78), IPD079Bf (SEQ ID NO: 80), IPD079Bg (SEQ ID NO: 82), IPD079Bh (SEQ ID NO: 84), IPD079Bi (SEQ ID NO: 86), IPD079Bj (SEQ ID NO: 88), IPD079Bk (SEQ ID NO: 90), IPD079Bl (SEQ ID NO: 92), and IPD079Bm (SEQ ID NO: 94). The sequence diversity is highlighted.

FIG. 2A-2J shows an amino acid sequence alignment, using of the ALIGNX® module of the Vector NTI® suite, of IPD079Eb (SEQ ID NO: 58), IPD079Ea (SEQ ID NO: 56), IPD079Eaa (SEQ ID NO: 132), IPD079Eab (SEQ ID NO: 134), IPD079Eac (SEQ ID NO: 136), IPD079Ead (SEQ ID NO: 138), IPD079Eae (SEQ ID NO: 140), IPD079Ec (SEQ ID NO: 60), IPD079Ed (SEQ ID NO: 62), IPD079Ee (SEQ ID NO: 64), IPD079Ef (SEQ ID NO: 66), IPD079Eg (SEQ ID NO: 68), IPD079Eh (SEQ ID NO: 70), IPD079Ei (SEQ ID NO: 96), IPD079Ej (SEQ ID NO: 98), IPD079Ek (SEQ ID NO: 100), IPD079El (SEQ ID NO: 102), IPD079Em (SEQ ID NO: 104), IPD079En (SEQ ID NO: 106), IPD079Eo (SEQ ID NO: 108), IPD079Ep (SEQ ID NO: 110), IPD079Eq (SEQ ID NO: 112), IPD079Er (SEQ ID NO: 114), IPD079Es (SEQ ID NO: 116), IPD079Et (SEQ ID NO: 118), IPD079Eu (SEQ ID NO: 120), IPD079Ev (SEQ ID NO: 122), IPD079Ew (SEQ ID NO: 124), IPD079Ex (SEQ ID NO: 126), IPD079Ey (SEQ ID NO: 128), IPD079Ez (SEQ ID NO: 130 and IPD079Fa (SEQ ID NO: 142). The sequence diversity is highlighted.

FIG. 6A-6B shows an amino acid sequence alignment, using the ALIGNX® module of the Vector NTI® suite, of IPD079Aa, (SEQ ID NO: 2), IPD079Ea (SEQ ID NO: 56), and the IPD079 chimeras: Chimera1 (SEQ ID NO: 1277), Chimera2 (SEQ ID NO: 1278), and Chimera3 (SEQ ID NO: 1276). The sequence diversity is highlighted. The crossover positions of the chimeras are indicated by a "▼" above the IPD079Aa sequence.

DETAILED DESCRIPTION

Figure 3:
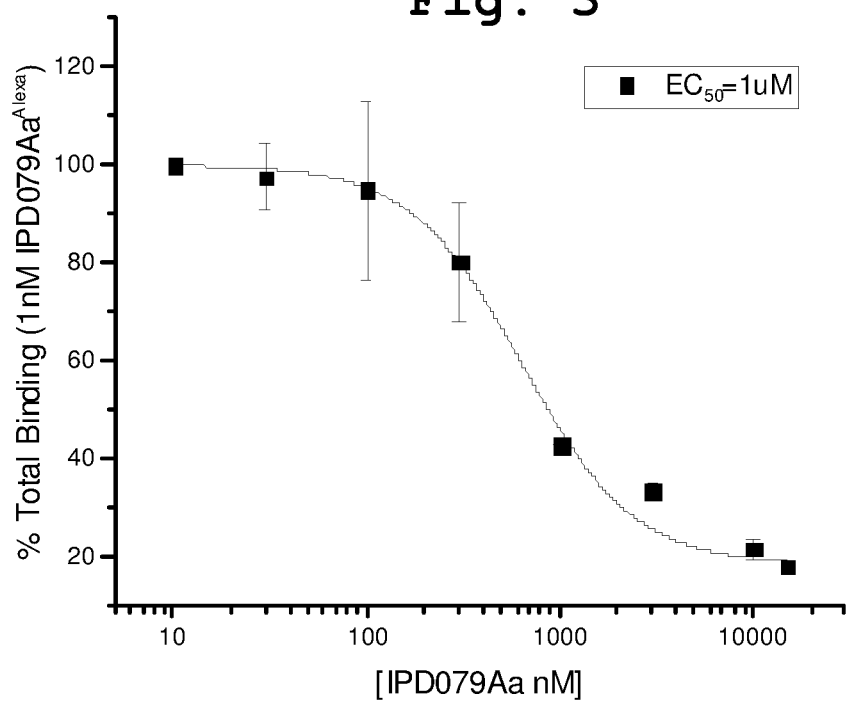
FIG. 3 shows a plot of the homologous competition of 1 nM Alexa-labeled IPD079Aa polypeptide (SEQ ID NO: 2) % total binding to Western Corn Rootworm (WCRW) brush border membrane vesicles (BBMV) versus the concentration (nM) of unlabeled IPD079Aa polypeptide (SEQ ID NO: 2).

It is to be understood that this disclosure is not limited to the particular methodology, protocols, cell lines, genera, and reagents described, as such may vary. It is also to be understood that the terminology used herein is for the purpose of describing particular embodiments only, and is not intended to limit the scope of the present disclosure.

As used herein the singular forms "a", "and", and "the" include plural referents unless the context clearly dictates otherwise. Thus, for example, reference to "a cell" includes a plurality of such cells and reference to "the protein" includes reference to one or more proteins and equivalents thereof known to those skilled in the art, and so forth. All technical and scientific terms used herein have the same meaning as commonly understood to one of ordinary skill in the art to which this disclosure belongs unless clearly indicated otherwise.

The present disclosure is drawn to compositions and methods for controlling pests. The methods involve transforming organisms with nucleic acid sequences encoding plant derived perforins. The methods involve transforming organisms with nucleic acid sequences encoding IPD079 polypeptides. In particular, the nucleic acid sequences of the embodiments are useful for preparing plants and microorganisms that possess pesticidal activity. Thus, transformed bacteria, plants, plant cells, plant tissues and seeds are provided. The compositions are nucleic acids sequences or perforins of plant species. The nucleic acid sequences find use in the construction of expression vectors for subsequent transformation into organisms of interest, as probes for the isolation of other homologous (or partially homologous) genes, and for the generation of altered plant derived perforin, particularly IPD079 polypeptides, by methods known in the art, such as site directed mutagenesis, domain swapping or DNA shuffling. The plant derived perforins find use in controlling or killing Lepidopteran, Coleopteran, Dipteran, fungal, Hemipteran and nematode pest populations and for producing compositions with pesticidal activity. Insect pests of interest include, but are not limited to, Lepidoptera species including but not limited to: Corn Earworm, (CEW) (*Helicoverpa zea*), European Corn Borer (ECB) (*Ostrinia nubilalis*), diamond-back moth, e.g., *Helicoverpa zea* Boddie; soybean looper, e.g., *Pseudoplusia includens* Walker; and velvet bean caterpillar e.g., *Anticarsia gemmatalis* Hübner and Coleoptera species including but not limited to Western corn rootworm (*Diabrotica virgifera*)—WCRW, Southern corn rootworm (*Diabrotica undecimpunctata howardi*)—SCRW, and Northern corn rootworm (*Diabrotica barberi*)—NCRW. The IPD079 polypeptides find use in controlling or killing Lepidopteran, Coleopteran, Dipteran, fungal, Hemipteran and nematode pest populations and for producing compositions with pesticidal activity.

By "pesticidal toxin" or "pesticidal protein" is used herein to refer to a toxin that has toxic activity against one or more pests, including, but not limited to, members of the Lepidoptera, Diptera, Hemiptera and Coleoptera orders or the Nematoda phylum or a protein that has homology to such a protein. Pesticidal proteins have been isolated from organisms including, for example, *Bacillus* sp., *Pseudomonas* sp., *Photorhabdus* sp., *Xenorhabdus* sp., *Clostridium bifermentans* and *Paenibacillus popilliae*. Pesticidal proteins include but are not limited to: insecticidal proteins from *Pseudomonas* sp. such as PSEEN3174 (Monalysin; (2011) *PLoS Pathogens* 7:1-13); from *Pseudomonas protegens* strain CHA0 and Pf-5 (previously *fluorescens*) (Pechy-Tarr, (2008) *Environmental Microbiology* 10:2368-2386; GenBank Accession No. EU400157); from *Pseudomonas Taiwanensis* (Liu, et al., (2010) *J. Agric. Food Chem.*, 58:12343-12349) and from *Pseudomonas pseudoalcligenes* (Zhang, et al., (2009) *Annals of Microbiology* 59:45-50 and Li, et al., (2007) *Plant Cell Tiss. Organ Cult.* 89:159-168); insecticidal proteins from *Photorhabdus* sp. and *Xenorhabdus* sp. (Hinchliffe, et al., (2010) *The Open Toxicology Journal*, 3:101-118 and Morgan, et al., (2001) *Applied and Envir. Micro.* 67:2062-2069); U.S. Pat. Nos. 6,048,838, and 6,379,946; a PIP-1 polypeptide of U.S. Patent Publication US20140007292; an AfIP-1A and/or AfIP-1B polypeptide of U.S. Patent Publication US20140033361; a PHI-4 polypeptide of U.S. Patent Publication US20140274885 and US20160040184; a PIP-47 polypeptide of PCT Publication Number WO2015/023,846, a PIP-72 polypeptide of PCT Publication Number WO2015/038,734; a PtIP-50 polypeptide and a PtIP-65 polypeptide of PCT Publication Number WO2015/120,270; a PtIP-83 polypeptide of PCT Publication Number WO2015/120,276; a PtIP-96 polypeptide of PCT Serial Number PCT/US15/55502; an IPD073 polypeptide of PCT Serial Number PCT/US16/32273, an IPD082 polypeptide of U.S. Ser. No. 62/269,482, and 6-endotoxins including, but not limited to, the Cry1, Cry2, Cry3, Cry4, Cry5, Cry6, Cry7, Cry8, Cry9, Cry10, Cry11, Cry12, Cry13, Cry14, Cry15, Cry16, Cry17, Cry18, Cry19, Cry20, Cry21, Cry22, Cry23, Cry24, Cry25, Cry26, Cry27, Cry 28, Cry 29, Cry 30, Cry31, Cry32, Cry33, Cry34, Cry35, Cry36, Cry37, Cry38, Cry39, Cry40, Cry41, Cry42, Cry43, Cry44, Cry45, Cry 46, Cry47, Cry49, Cry50, Cry51, Cry52, Cry53, Cry 54, Cry55, Cry56, Cry57, Cry58, Cry59, Cry60, Cry61, Cry62, Cry63, Cry64, Cry65, Cry66, Cry67, Cry68, Cry69, Cry70, Cry71, Cry72, Cry73, and Cry 74 classes of δ-endotoxin genes and the *B. thuringiensis* cytolytic cyt1 and cyt2 genes. Members of these classes of *B. thuringiensis* insecticidal proteins well known to one skilled in the art (see, Crickmore, et al., "*Bacillus thuringiensis* toxin nomenclature" (2011), at lifesci.sussex.ac.uk/home/Neil_Crickmore/Bt/ which can be accessed on the world-wide web using the "www" prefix).

Examples of δ-endotoxins also include but are not limited to Cry1A proteins of U.S. Pat. Nos. 5,880,275 and 7,858,849; a DIG-3 or DIG-11 toxin (N-terminal deletion of α-helix 1 and/or α-helix 2 variants of cry proteins such as Cry1A, Cry3A) of U.S. Pat. Nos. 8,304,604, 8,304,605, 8,476,226, and 9,006,520; Cry1B of U.S. Patent Application Publication Number 2006/0112447; Cry1C of U.S. Pat. No. 6,033,874; Cry1F of U.S. Pat. Nos. 5,188,960 and 6,218,188; Cry1A/F chimeras of U.S. Pat. Nos. 7,070,982; 6,962,705 and 6,713,063); a Cry2 protein such as Cry2Ab protein of U.S. Pat. No. 7,064,249); a Cry3A protein including but not limited to an engineered hybrid insecticidal protein (eHIP) created by fusing unique combinations of variable regions and conserved blocks of at least two different Cry proteins (US Patent Application Publication Number 2010/0017914); a Cry4 protein; a Cry5 protein; a Cry6 protein; Cry8 proteins of U.S. Pat. Nos. 7,329,736, 7,449,552, 7,803,943, 7,476,781, 7,105,332, 7,378,499 and 7,462,760; a Cry9 protein such as such as members of the Cry9A, Cry9B, Cry9C, Cry9D, Cry9E and Cry9F families; a Cry15 protein of Naimov, et al., (2008) *Applied and Environmental Microbiology,* 74:7145-7151; a Cry22, a Cry34Ab1 protein of U.S. Pat. Nos. 6,127,180, 6,624,145 and 6,340,593; a CryET33 and cryET34 protein of U.S. Pat. Nos. 6,248,535, 6,326,351, 6,399,330, 6,949,626, 7,385,107 and 7,504,229; a CryET33 and CryET34 homologs of U.S. Pat. No. 8,796,026, US Patent Publication Number 2012/0278954, and PCT Publication Number WO 2012/139,004; a Cry35Ab1 protein of U.S. Pat. Nos. 6,083,499, 6,548,291 and 6,340,593; a Cry46 protein, a Cry 51 protein, a Cry binary toxin; a TIC901 or related toxin; TIC807 of U.S. Pat. No. 8,609,936; ET29, ET37, TIC809, TIC810, TIC812, TIC127, TIC128 of WO 2007/027,776; AXMI-027, AXMI-036, and AXMI-038 of U.S. Pat. No. 8,236,757; AXMI-031, AXMI-039, AXMI-040, AXMI-049 of U.S. Pat. No. 7,923,602; AXMI-018, AXMI-020 and AXMI-021 of WO 2006/083,891; AXMI-010 of WO 2005/038,032; AXMI-003 of WO 2005/021,585; AXMI-008 of U.S. Pat. No. 7,351,881; AXMI-006 of U.S.

Patent Application Publication Number 2004/0216186; AXMI-007 of U.S. Patent Application Publication Number 2004/0210965; AXMI-009 of U.S. Patent Application Number 2004/0210964; AXMI-014 of U.S. Patent Application Publication Number 2004/0197917; AXMI-004 of U.S. Pat. No. 7,355,099; AXMI-028 and AXMI-029 of WO 2006/119,457, U.S. Pat. Nos. 7,622,572, 7,803,925, 7,803,391, 7,811,598, 8,314,292; AXMI-007, AXMI-008, AXMI-0080, AXMI-009, AXMI-014 and AXMI-004 of WO 2004/074, 462; AXMI-150 of U.S. Pat. No. 8,084,416; AXMI-205 of US Patent Application Publication Number 2011/0023184; AXMI-011, AXMI-012, AXMI-013, AXMI-015, AXMI-019, AXMI-044, AXMI-037, AXMI-043, AXMI-033, AXMI-034, AXMI-022, AXMI-023, AXMI-041, AXMI-063 and AXMI-064 of U.S. Pat. No. 8,829,279 or U.S. Patent Publication Number US20140344999; AXMI-R1 and related proteins of U.S. Pat. No. 8,299,217; AXMI221Z, AXMI222z, AXMI223z, AXMI224z and AXMI225z of U.S. Pat. No. 8,686,124; AXMI218, AXMI219, AXMI220, AXMI226, AXMI227, AXMI228, AXMI229, AXMI230 and AXMI231 of U.S. Pat. No. 8,759,619; AXMI-115, AXMI-113, AXMI-005, AXMI-163 and AXMI-184 of U.S. Pat. No. 8,334,431; AXMI-001, AXMI-002, AXMI-030, AXMI-035 and AXMI-045 of US Patent Application Publication Number 2013/0117884; AXMI-066 and AXMI-076 of US Patent Application Publication Number 2009/0144852; AXMI128, AXMI130, AXMI131, AXMI133, AXMI140, AXMI141, AXMI142, AXMI143, AXMI144, AXMI146, AXMI148, AXMI149, AXMI152, AXMI153, AXMI154, AXMI155, AXMI156, AXMI157, AXMI158, AXMI162, AXMI165, AXMI166, AXMI167, AXMI168, AXMI169, AXMI170, AXMI171, AXMI172, AXMI173, AXMI174, AXMI175, AXMI176, AXMI177, AXMI178, AXMI179, AXMI180, AXMI181, AXMI182, AXMI185, AXMI186, AXMI187, AXMI188, AXMI189 of U.S. Pat. No. 8,318,900 or U.S. Patent Publication Number 2013/0055469; AXMI079, AXMI080, AXMI081, AXMI082, AXMI091, AXMI092, AXMI096, AXMI097, AXMI098, AXMI099, AXMI100, AXMI101, AXMI102, AXMI103, AXMI104, AXMI107, AXMI108, AXMI109, AXMI110, AXMI111, AXMI112, AXMI114, AXMI116, AXMI117, AXMI118, AXMI119, AXMI120, AXMI121, AXMI122, AXMI123, AXMI124, AXMI1257, AXMI1268, AXMI127, AXMI129, AXMI164, AXMI151, AXMI161, AXMI183, AXMI132, AXMI138, AXMI137 of U.S. Pat. No. 8,461,421 and U.S. Patent Publication Number 2013/0305412, cry proteins such as Cry1A and Cry3A having modified proteolytic sites of U.S. Pat. No. 8,319,019; a Cry1Ac, Cry2Aa and Cry1Ca toxin protein from *Bacillus thuringiensis* strain VBTS 2528 of U.S. Pat. No. 8,551,757. The insecticidal activity of Cry proteins is well known to one skilled in the art (for review, see, van Frannkenhuyzen, (2009) *J. Invert. Path.* 101:1-16). The use of Cry proteins as transgenic plant traits is well known to one skilled in the art and Cry-transgenic plants including but not limited to plants expressing Cry1Ac, Cry1Ac+Cry2Ab, Cry1Ab, Cry1A.105, Cry1F, Cry1Fa2, Cry1F+Cry1Ac, Cry2Ab, Cry3A, mCry3A, Cry3Bb1, Cry34Ab1, Cry35Ab1, Vip3A, mCry3A, Cry9c and CBI-Bt have received regulatory approval (see, Sanahuja, (2011) *Plant Biotech Journal* 9:283-300 and the CERA. (2010) GM Crop Database Center for Environmental Risk Assessment (CERA), ILSI Research Foundation, Washington D.C. at cera-gmc.org/index.php?action=gm_crop_database which can be accessed on the world-wide web using the "www" prefix). More than one pesticidal proteins well known to one skilled in the art can also be expressed in plants such as Vip3Ab & Cry1Fa (US2012/0317682); Cry1BE & Cry1F (US2012/0311746); Cry1CA & Cry1AB (US2012/0311745); Cry1F & CryCa (US2012/0317681); Cry1DA & Cry1BE (US2012/0331590); Cry1DA & Cry1Fa (US2012/0331589); Cry1AB & Cry1BE (US2012/0324606); Cry1Fa & Cry2Aa and Cry1I & Cry1E (US2012/0324605); Cry34Ab/35Ab and Cry6Aa (US20130167269); Cry34Ab/VCry35Ab & Cry3Aa (US20130167268); and Cry3A and Cry1Ab or Vip3Aa (US20130116170). Pesticidal proteins also include insecticidal lipases including lipid acyl hydrolases of U.S. Pat. No. 7,491,869, and cholesterol oxidases such as from *Streptomyces* (Purcell et al. (1993) *Biochem Biophys Res Commun* 15:1406-1413). Pesticidal proteins also include VIP (vegetative insecticidal proteins) toxins of U.S. Pat. Nos. 5,877,012, 6,107,279 6,137,033, 7,244,820, 7,615,686, and 8,237,020 and the like. Other VIP proteins are well known to one skilled in the art (see, lifesci.sussex.ac.uk/home/Neil_Crickmore/Bt/vip.html which can be accessed on the world-wide web using the "www" prefix). Pesticidal proteins also include toxin complex (TC) proteins, obtainable from organisms such as *Xenorhabdus, Photorhabdus* and *Paenibacillus* (see, U.S. Pat. Nos. 7,491,698 and 8,084,418). Some TC proteins have "stand alone" insecticidal activity and other TC proteins enhance the activity of the stand-alone toxins produced by the same given organism. The toxicity of a "stand-alone" TC protein (from *Photorhabdus, Xenorhabdus* or *Paenibacillus*, for example) can be enhanced by one or more TC protein "potentiators" derived from a source organism of a different genus. There are three main types of TC proteins. As referred to herein, Class A proteins ("Protein A") are stand-alone toxins. Class B proteins ("Protein B") and Class C proteins ("Protein C") enhance the toxicity of Class A proteins. Examples of Class A proteins are TcbA, TcdA, XptA1 and XptA2. Examples of Class B proteins are TcaC, TcdB, XptB1Xb and XptC1Wi. Examples of Class C proteins are TccC, XptC1Xb and XptB1Wi. Pesticidal proteins also include spider, snake and scorpion venom proteins. Examples of spider venom peptides include but not limited to lycotoxin-1 peptides and mutants thereof (U.S. Pat. No. 8,334,366).

In some embodiments the IPD079 polypeptide include amino acid sequences deduced from the full-length nucleic acid sequences disclosed herein and amino acid sequences that are shorter than the full-length sequences, either due to the use of an alternate downstream start site or due to processing that produces a shorter protein having pesticidal activity. Processing may occur in the organism the protein is expressed in or in the pest after ingestion of the protein.

Thus, provided herein are novel isolated or recombinant nucleic acid sequences that confer pesticidal activity. Also provided are the amino acid sequences of IPD079 polypeptides. The protein resulting from translation of these IPD079 polypeptide genes allows cells to control or kill pests that ingest it.

Nucleic Acid Molecules, and Variants and Fragments Thereof

In some embodiments isolated or recombinant nucleic acid molecules comprising nucleic acid sequences encoding plant derived perforins or biologically active portions thereof, as well as nucleic acid molecules sufficient for use as hybridization probes to identify nucleic acid molecules encoding proteins with regions of sequence homology. One embodiment pertains to isolated or recombinant nucleic acid molecules comprising nucleic acid sequences encoding IPD079 polypeptides or biologically active portions thereof, as well as nucleic acid molecules sufficient for use as hybridization probes to identify nucleic acid molecules encoding proteins with regions of sequence homology. As used herein, the term "nucleic acid molecule" refers to DNA molecules (e.g., recombinant DNA, cDNA, genomic DNA, plastid DNA, mitochondrial DNA) and RNA molecules (e.g., mRNA) and analogs of the DNA or RNA generated using nucleotide analogs. The nucleic acid molecule can be single-stranded or double-stranded, but preferably is double-stranded DNA.

An "isolated" nucleic acid molecule (or DNA) is used herein to refer to a nucleic acid sequence (or DNA) that is no longer in its natural environment, for example in vitro. A "recombinant" nucleic acid molecule (or DNA) is used herein to refer to a nucleic acid sequence (or DNA) that is in a recombinant bacterial or plant host cell. In some embodiments, an "isolated" or "recombinant" nucleic acid is free of sequences (preferably protein encoding sequences) that naturally flank the nucleic acid (i.e., sequences located at the 5' and 3' ends of the nucleic acid) in the genomic DNA of the organism from which the nucleic acid is derived. For purposes of the disclosure, "isolated" or "recombinant" when used to refer to nucleic acid molecules excludes isolated chromosomes. For example, in various embodiments, the recombinant nucleic acid molecule encoding IPD079 polypeptides can contain less than about 5 kb, 4 kb, 3 kb, 2 kb, 1 kb, 0.5 kb or 0.1 kb of nucleic acid sequences that naturally flank the nucleic acid molecule in genomic DNA of the cell from which the nucleic acid is derived.

In some embodiments an isolated nucleic acid molecule encoding a plant derived perforin or IPD079 polypeptide has one or more change in the nucleic acid sequence compared to the native or genomic nucleic acid sequence. In some embodiments the change in the native or genomic nucleic acid sequence includes but is not limited to: changes in the nucleic acid sequence due to the degeneracy of the genetic code; changes in the nucleic acid sequence due to the amino acid substitution, insertion, deletion and/or addition compared to the native or genomic sequence; removal of one or more intron; deletion of one or more upstream or downstream regulatory regions; and deletion of the 5' and/or 3' untranslated region associated with the genomic nucleic acid sequence. In some embodiments the nucleic acid molecule encoding a plant derived perforins or IPD079 polypeptide of the disclosure is a non-genomic sequence.

A variety of polynucleotides that encode plant derived perforins and IPD079 polypeptides or related proteins are contemplated. Such polynucleotides are useful for production of plant derived perforins and IPD079 polypeptides of the disclosure in host cells when operably linked to suitable promoter, enhancer, transcription termination and/or polyadenylation sequences. Such polynucleotides are also useful as probes for isolating homologous or substantially homologous polynucleotides that encode plant derived perforins and IPD079 polypeptides or related proteins.

Polynucleotides Encoding IPD079 Polypeptides

One source of polynucleotides that encode plant derived perforins and IPD079 polypeptides or related protein is a fern or other primitive plant species. One source of polynucleotides that encode IPD079 polypeptides or related proteins is a fern or other primitive plant species that contains an IPD079 polynucleotide of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 87, SEQ ID NO: 89, SEQ ID NO: 91, SEQ ID NO: 93, SEQ ID NO: 57, SEQ ID NO: 55, SEQ ID NO: 59, SEQ ID NO: 61, SEQ ID NO: 63, SEQ ID NO: 65, SEQ ID NO: 67, SEQ ID NO: 69, SEQ ID NO: 95, SEQ ID NO: 97, SEQ ID NO: 99, SEQ ID NO: 101, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137 or SEQ ID NO: 139 encoding an IPD079 polypeptide of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138 or SEQ ID NO: 140. The polynucleotides of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 87, SEQ ID NO: 89, SEQ ID NO: 91, SEQ ID NO: 93, SEQ ID NO: 57, SEQ ID NO: 55, SEQ ID NO: 59, SEQ ID NO: 61, SEQ ID NO: 63, SEQ ID NO: 65, SEQ ID NO: 67, SEQ ID NO: 69, SEQ ID NO: 95, SEQ ID NO: 97, SEQ ID NO: 99, SEQ ID NO: 101, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137 or SEQ ID NO: 139 can be used to express IPD079 polypeptides in bacterial hosts that include but are not limited to *Agrobacterium, Bacillus, Escherichia, Salmonella, Pseudomonas* and *Rhizobium* bacterial host cells. The polynucleotides are also useful as probes for isolating homologous or substantially homologous polynucleotides that encode IPD079 polypeptides or related proteins. Such probes can be used to identify homologous or substantially homologous polynucleotides derived from Pteridophyta species.

Polynucleotides that encode plant derived perforins and IPD079 polypeptides of the disclosure can also be synthesized de novo from the plant derived perforins or IPD079 polypeptide sequence. The sequence of the polynucleotide gene can be deduced from an IPD079 polypeptide sequence, through use of the genetic code. Computer programs such as "BackTranslate" (GCG™ Package, Acclerys, Inc. San Diego, Calif.) can be used to convert a peptide sequence to the corresponding nucleotide sequence encoding the peptide. Examples of plant derived perforin sequences that can be used to obtain corresponding nucleotide encoding sequences include, but are not limited to the polypeptides of any one of SEQ ID NOs: 158-1248. Examples of IPD079 polypeptide sequences that can be used to obtain corresponding nucleotide encoding sequences include, but are not limited to the IPD079 polypeptides of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, and SEQ ID NO: 140. Furthermore, synthetic polynucleotide sequences encoding plant derived perforins and IPD079 polypeptides of the disclosure can be designed so that they will be expressed in plants. U.S. Pat. No. 5,500,365 describes a method for synthesizing plant genes to improve the expression level of the protein encoded by the synthesized gene. This method relates to the modification of the structural gene sequences of the exogenous transgene, to cause them to be more efficiently transcribed, processed, translated and expressed by the plant. Features of genes that are expressed well in plants include elimination of sequences that can cause undesired intron splicing or polyadenylation in the coding region of a gene transcript while retaining substantially the amino acid sequence of the toxic portion of the insecticidal protein. A similar method for obtaining enhanced expression of transgenes in monocotyledonous plants is disclosed in U.S. Pat. No. 5,689,052.

In some embodiments the nucleic acid molecule encoding an IPD079 polypeptide is a polynucleotide having the sequence set forth in SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 87, SEQ ID NO: 89, SEQ ID NO: 91, SEQ ID NO: 93, SEQ ID NO: 57, SEQ ID NO: 55, SEQ ID NO: 59, SEQ ID NO: 61, SEQ ID NO: 63, SEQ ID NO: 65, SEQ ID NO: 67, SEQ ID NO: 69, SEQ ID NO: 95, SEQ ID NO: 97, SEQ ID NO: 99, SEQ ID NO: 101, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137 or SEQ ID NO: 139, and variants, fragments and complements thereof. "Complement" is used herein to refer to a nucleic acid sequence that is sufficiently complementary to a given nucleic acid sequence such that it can hybridize to the given nucleic acid sequence to thereby form a stable duplex. "Polynucleotide sequence variants" is used herein to refer to a nucleic acid sequence that except for the degeneracy of the genetic code encodes the same polypeptide.

In some embodiments the nucleic acid molecule encoding the plant derived perforin or IPD079 polypeptide is a non-genomic nucleic acid sequence. As used herein a "non-genomic nucleic acid sequence" or "non-genomic nucleic acid molecule" or "non-genomic polynucleotide" refers to a nucleic acid molecule that has one or more change in the nucleic acid sequence compared to a native or genomic nucleic acid sequence. In some embodiments the change to a native or genomic nucleic acid molecule includes but is not limited to: changes in the nucleic acid sequence due to the degeneracy of the genetic code; codon optimization of the nucleic acid sequence for expression in plants; changes in the nucleic acid sequence to introduce at least one amino acid substitution, insertion, deletion and/or addition compared to the native or genomic sequence; removal of one or more intron associated with the genomic nucleic acid sequence; insertion of one or more heterologous introns; deletion of one or more upstream or downstream regulatory regions associated with the genomic nucleic acid sequence; insertion of one or more heterologous upstream or downstream regulatory regions; deletion of the 5' and/or 3' untranslated region associated with the genomic nucleic acid sequence; insertion of a heterologous 5' and/or 3' untranslated region; and modification of a polyadenylation site. In some embodiments the non-genomic nucleic acid molecule is a cDNA. In some embodiments the non-genomic nucleic acid molecule is a synthetic nucleic acid sequence.

In some embodiments the nucleic acid molecule encoding an IPD079 polypeptide is a the non-genomic polynucleotide having a nucleotide sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 7.4%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity, to the nucleic acid sequence of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 87, SEQ ID NO: 89, SEQ ID NO: 91, SEQ ID NO: 93, SEQ ID NO: 57, SEQ ID NO: 55, SEQ ID NO: 59, SEQ ID NO: 61, SEQ ID NO: 63, SEQ ID NO: 65, SEQ ID NO: 67, SEQ ID NO: 69, SEQ ID NO: 95, SEQ ID NO: 97, SEQ ID NO: 99, SEQ ID NO: 101, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO:

121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137 or SEQ ID NO: 139, wherein the IPD079 polypeptide has insecticidal activity.

In some embodiments the nucleic acid molecule encodes an IPD079 polypeptide comprising an amino acid sequence of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138 or SEQ ID NO: 140, having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70 or more amino acid substitutions compared to the native amino acid at the corresponding position of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138 or SEQ ID NO: 140.

In some embodiments the nucleic acid molecule encodes the plant derived perforin polypeptide of any one of SEQ ID NOs: 158-1248.

In some embodiments the nucleic acid molecule encoding the plant derived perforin or IPD079 polypeptide is derived from a fern species in the Division Pteridophyta. The phylogeny of ferns as used herein is based on the classification for extant ferns by A. R. Smith et al, *TAXON*, 55:705-731 (2006). Other phylogenic classifications of extant ferns are known to one skilled in the art. Additional information on the phylogeny of ferns can be found at mobot.org/MOBOT/research/APweb/ (which can be accessed using the "www" prefix) and Schuettpelz E. and Pryer K. M., *TAXON* 56: 1037-1050 (2007) based on three plastid genes. Additional fern and other primitive plant species can be found at homepages.caverock.net.nz/~bj/fern/list.htm (which can be accessed using the http:// prefix).

Also provided are nucleic acid molecules that encode transcription and/or translation products that are subsequently spliced to ultimately produce functional plant derived perforins or IPD079 polypeptides. Splicing can be accomplished in vitro or in vivo, and can involve cis- or trans-splicing. The substrate for splicing can be polynucleotides (e.g., RNA transcripts) or polypeptides. An example of cis-splicing of a polynucleotide is where an intron inserted into a coding sequence is removed and the two flanking exon regions are spliced to generate an IPD079 polypeptide encoding sequence. An example of trans splicing would be where a polynucleotide is encrypted by separating the coding sequence into two or more fragments that can be separately transcribed and then spliced to form the full-length pesticidal encoding sequence. The use of a splicing enhancer sequence, which can be introduced into a construct, can facilitate splicing either in cis or trans-splicing of polypeptides (U.S. Pat. Nos. 6,365,377 and 6,531,316). Thus, in some embodiments the polynucleotides do not directly encode a full-length IPD079 polypeptide, but rather encode a fragment or fragments of an IPD079 polypeptide. These polynucleotides can be used to express a functional IPD079 polypeptide through a mechanism involving splicing, where splicing can occur at the level of polynucleotide (e.g., intron/exon) and/or polypeptide (e.g., intein/extein). This can be useful, for example, in controlling expression of pesticidal activity, since a functional pesticidal polypeptide will only be expressed if all required fragments are expressed in an environment that permits splicing processes to generate functional product. In another example, introduction of one or more insertion sequences into a polynucleotide can facilitate recombination with a low homology polynucleotide; use of an intron or intein for the insertion sequence facilitates the removal of the intervening sequence, thereby restoring function of the encoded variant.

Nucleic acid molecules that are fragments of these nucleic acid sequences encoding IPD079 polypeptides are also encompassed by the embodiments. "Fragment" as used herein refers to a portion of the nucleic acid sequence encoding an IPD079 polypeptide. A fragment of a nucleic acid sequence may encode a biologically active portion of an IPD079 polypeptide or it may be a fragment that can be used as a hybridization probe or PCR primer using methods disclosed below. Nucleic acid molecules that are fragments of a nucleic acid sequence encoding an IPD079 polypeptide comprise at least about 180, 210, 240, 270, 300, 330, 360, 390 or 420 contiguous nucleotides or up to the number of nucleotides present in a full-length nucleic acid sequence encoding an IPD079 polypeptide disclosed herein, depending upon the intended use. "Contiguous nucleotides" is used herein to refer to nucleotide residues that are immediately adjacent to one another. Fragments of the nucleic acid sequences of the embodiments will encode protein fragments that retain the biological activity of the IPD079 polypeptide and, hence, retain insecticidal activity. "Retains insecticidal activity" is used herein to refer to a polypeptide having at least about 10%, at least about 30%, at least about 50%, at least about 70%, 80%, 90%, 95% or higher of the insecticidal activity of the full-length polypeptide. In some embodiments the IPD079 polypeptide has at least about 10%, at least about 30%, at least about 50%, at least about 70%, 80%, 90%, 95% or higher of the insecticidal activity of the full-length IPD079Aa polypeptide (SEQ ID NO: 2). In one embodiment, the insecticidal activity is against a Coleopteran species. In one embodiment, the insecticidal activity is against a *Diabrotica* species. In some embodiments, the insecticidal activity is against one or more insect pests of the corn rootworm complex: western corn rootworm, *Diabrotica virgifera*; northern corn rootworm, *D. barberi*; Southern corn rootworm or spotted cucumber beetle; *Diabrotica undecimpunctata howardi*, and the Mexican corn rootworm, *D. virgifera zeae*.

In some embodiments a fragment of a nucleic acid sequence encoding an IPD079 polypeptide encoding a biologically active portion of a protein will encode at least about 15, 20, 30, 50, 75, 100, 125, contiguous amino acids or up to the total number of amino acids present in the full-length IPD079 polypeptide of the disclosure. In some embodiments, the fragment is an N-terminal and/or a C-terminal truncation of at least about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34 or more amino acids from the N-terminus and/or C-terminus relative to SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138 or SEQ ID NO: 140 or variants thereof, e.g., by proteolysis, insertion of a start codon, deletion of the codons encoding the deleted amino acids with the concomitant insertion of a stop codon or by insertion of a stop codon in the coding sequence.

In some embodiments the IPD079 polypeptide is encoded by a nucleic acid sequence sufficiently homologous to the nucleic acid sequence of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 87, SEQ ID NO: 89, SEQ ID NO: 91, SEQ ID NO: 93, SEQ ID NO: 57, SEQ ID NO: 55, SEQ ID NO: 59, SEQ ID NO: 61, SEQ ID NO: 63, SEQ ID NO: 65, SEQ ID NO: 67, SEQ ID NO: 69, SEQ ID NO: 95, SEQ ID NO: 97, SEQ ID NO: 99, SEQ ID NO: 101, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137 or SEQ ID NO: 139. "Sufficiently homologous" is used herein to refer to an amino acid or nucleic acid sequence that has at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater sequence homology compared to a reference sequence using one of the alignment programs described herein using standard parameters. One of skill in the art will recognize that these values can be appropriately adjusted to determine corresponding homology of proteins encoded by two nucleic acid sequences by taking into account codon degeneracy, amino acid similarity, reading frame positioning, and the like. In some embodiments the sequence homology is against the full length sequence of the polynucleotide encoding an IPD079 polypeptide or against the full length sequence of an IPD079 polypeptide.

In some embodiments the nucleic acid encoding an IPD079 polypeptide is selected from SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 87, SEQ ID NO: 89, SEQ ID NO: 91, SEQ ID NO: 93, SEQ ID NO: 57, SEQ ID NO: 55, SEQ ID NO: 59, SEQ ID NO: 61, SEQ ID NO: 63, SEQ ID NO: 65, SEQ ID NO: 67, SEQ ID NO: 69, SEQ ID NO: 95, SEQ ID NO: 97, SEQ ID NO: 99, SEQ ID NO: 101, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137 or SEQ ID NO: 139.

In some embodiments the nucleic acid encodes an IPD079 polypeptide having at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater sequence identity compared to SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138 or SEQ ID NO: 140. In some embodiments the sequence identity is calculated using ClustalW algorithm in the ALIGNX® module of the Vector NTI® Program Suite (Invitrogen Corporation, Carlsbad, Calif.) with all default parameters. In some embodiments the sequence identity is across the entire length of polypeptide calculated using ClustalW algorithm in the ALIGNX module of the Vector NTI Program Suite (Invitrogen Corporation, Carlsbad, Calif.) with all default parameters.

In some embodiments the nucleic acid encodes an IPD079 polypeptide having at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater sequence identity compared to SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92 or SEQ ID NO: 94.

In some embodiments the nucleic acid encodes an IPD079 polypeptide having at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater sequence identity compared to SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140.

To determine the percent identity of two amino acid sequences or of two nucleic acid sequences, the sequences are aligned for optimal comparison purposes. The percent identity between the two sequences is a function of the number of identical positions shared by the sequences (i.e., percent identity=number of identical positions/total number of positions (e.g., overlapping positions)×100). In one embodiment, the two sequences are the same length. In another embodiment, the comparison is across the entirety of the reference sequence (e.g., across the entirety of SEQ ID NO: 1). The percent identity between two sequences can be determined using techniques similar to those described below, with or without allowing gaps. In calculating percent identity, typically exact matches are counted.

Another non-limiting example of a mathematical algorithm utilized for the comparison of sequences is the algorithm of Needleman and Wunsch, (1970) *J. Mol. Biol.* 48(3):443-453, used GAP Version 10 software to determine sequence identity or similarity using the following default parameters: % identity and % similarity for a nucleic acid sequence using GAP Weight of 50 and Length Weight of 3, and the nwsgapdna.cmpii scoring matrix; % identity or % similarity for an amino acid sequence using GAP weight of 8 and length weight of 2, and the BLOSUM62 scoring program. Equivalent programs may also be used. "Equivalent program" is used herein to refer to any sequence comparison program that, for any two sequences in question, generates an alignment having identical nucleotide residue matches and an identical percent sequence identity when compared to the corresponding alignment generated by GAP Version 10.

The embodiments also encompass nucleic acid molecules encoding IPD079 polypeptide variants. "Variants" of the IPD079 polypeptide encoding nucleic acid sequences include those sequences that encode the IPD079 polypeptides disclosed herein but that differ conservatively because of the degeneracy of the genetic code as well as those that are sufficiently identical as discussed above. Naturally occurring allelic variants can be identified with the use of well-known molecular biology techniques, such as polymerase chain reaction (PCR) and hybridization techniques as outlined below. Variant nucleic acid sequences also include synthetically derived nucleic acid sequences that have been generated, for example, by using site-directed mutagenesis but which still encode the IPD079 polypeptides disclosed as discussed below.

The present disclosure provides isolated or recombinant polynucleotides that encode any of the IPD079 polypeptides disclosed herein. Those having ordinary skill in the art will readily appreciate that due to the degeneracy of the genetic code, a multitude of nucleotide sequences encoding IPD079 polypeptides of the present disclosure exist.

The skilled artisan will further appreciate that changes can be introduced by mutation of the nucleic acid sequences thereby leading to changes in the amino acid sequence of the encoded IPD079 polypeptides, without altering the biological activity of the proteins. Thus, variant nucleic acid molecules can be created by introducing one or more nucleotide substitutions, additions and/or deletions into the corresponding nucleic acid sequence disclosed herein, such that one or more amino acid substitutions, additions or deletions are introduced into the encoded protein. Mutations can be introduced by standard techniques, such as site-directed mutagenesis and PCR-mediated mutagenesis. Such variant nucleic acid sequences are also encompassed by the present disclosure.

Alternatively, variant nucleic acid sequences can be made by introducing mutations randomly along all or part of the coding sequence, such as by saturation mutagenesis, and the resultant mutants can be screened for ability to confer pesticidal activity to identify mutants that retain activity. Following mutagenesis, the encoded protein can be expressed recombinantly, and the activity of the protein can be determined using standard assay techniques.

The polynucleotides of the disclosure and fragments thereof are optionally used as substrates for a variety of recombination and recursive recombination reactions, in addition to standard cloning methods as set forth in, e.g., Ausubel, Berger and Sambrook, i.e., to produce additional pesticidal polypeptide homologues and fragments thereof with desired properties. A variety of such reactions are known, including those developed by the inventors and their co-workers. Methods for producing a variant of any nucleic acid listed herein comprising recursively recombining such polynucleotide with a second (or more) polynucleotide, thus forming a library of variant polynucleotides are also embodiments of the disclosure, as are the libraries produced, the cells comprising the libraries and any recombinant polynucleotide produces by such methods. Additionally, such methods optionally comprise selecting a variant polynucleotide from such libraries based on pesticidal activity, as is wherein such recursive recombination is done in vitro or in vivo.

A variety of diversity generating protocols, including nucleic acid recursive recombination protocols are available and fully described in the art. The procedures can be used separately, and/or in combination to produce one or more variants of a nucleic acid or set of nucleic acids, as well as variants of encoded proteins. Individually and collectively, these procedures provide robust, widely applicable ways of generating diversified nucleic acids and sets of nucleic acids (including, e.g., nucleic acid libraries) useful, e.g., for the engineering or rapid evolution of nucleic acids, proteins, pathways, cells and/or organisms with new and/or improved characteristics.

While distinctions and classifications are made in the course of the ensuing discussion for clarity, it will be appreciated that the techniques are often not mutually exclusive. Indeed, the various methods can be used singly or in combination, in parallel or in series, to access diverse sequence variants.

The result of any of the diversity generating procedures described herein can be the generation of one or more nucleic acids, which can be selected or screened for nucleic acids with or which confer desirable properties or that encode proteins with or which confer desirable properties. Following diversification by one or more of the methods herein or otherwise available to one of skill, any nucleic acids that are produced can be selected for a desired activity or property, e.g. pesticidal activity or, such activity at a desired pH, etc. This can include identifying any activity that can be detected, for example, in an automated or automatable format, by any of the assays in the art, see, e.g., discussion of screening of insecticidal activity, infra. A variety of related (or even unrelated) properties can be evaluated, in serial or in parallel, at the discretion of the practitioner.

Descriptions of a variety of diversity generating procedures for generating modified nucleic acid sequences, e.g., those coding for polypeptides having pesticidal activity or fragments thereof, are found in the following publications and the references cited therein: Soong, et al., (2000) *Nat Genet* 25(4):436-439; Stemmer, et al., (1999) *Tumor Targeting* 4:1-4; Ness, et al., (1999) *Nat Biotechnol* 17:893-896; Chang, et al., (1999) *Nat Biotechnol* 17:793-797; Minshull and Stemmer, (1999) *Curr Opin Chem Biol* 3:284-290; Christians, et al., (1999) *Nat Biotechnol* 17:259-264; Crameri, et al., (1998) *Nature* 391:288-291; Crameri, et al., (1997) *Nat Biotechnol* 15:436-438; Zhang, et al., (1997) *PNAS USA* 94:4504-4509; Patten, et al., (1997) *Curr Opin Biotechnol* 8:724-733; Crameri, et al., (1996) *Nat Med* 2:100-103; Crameri, et al., (1996) *Nat Biotechnol* 14:315-319; Gates, et al., (1996) *J Mol Biol* 255:373-386; Stemmer, (1996) "Sexual PCR and Assembly PCR" In: *The Encyclopedia of Molecular Biology*. VCH Publishers, New York. pp. 447-457; Crameri and Stemmer, (1995) *BioTechniques* 18:194-195; Stemmer, et al., (1995) *Gene*, 164:49-53; Stemmer, (1995) *Science* 270: 1510; Stemmer, (1995) *Bio/Technology* 13:549-553; Stemmer, (1994) *Nature* 370:389-391 and Stemmer, (1994) *PNAS USA* 91:10747-10751.

Mutational methods of generating diversity include, for example, site-directed mutagenesis (Ling, et al., (1997) *Anal Biochem* 254(2):157-178; Dale, et al., (1996) *Methods Mol Biol* 57:369-374; Smith, (1985) *Ann Rev Genet* 19:423-462; Botstein and Shortle, (1985) *Science* 229:1193-1201; Carter, (1986) *Biochem J* 237:1-7 and Kunkel, (1987) "The efficiency of oligonucleotide directed mutagenesis" in *Nucleic Acids & Molecular Biology* (Eckstein and Lilley, eds., Springer Verlag, Berlin)); mutagenesis using uracil containing templates (Kunkel, (1985) *PNAS USA* 82:488-492; Kunkel, et al., (1987) *Methods Enzymol* 154:367-382 and Bass, et al., (1988) *Science* 242:240-245); oligonucleotide-directed mutagenesis (Zoller and Smith, (1983) *Methods Enzymol* 100:468-500; Zoller and Smith, (1987) *Methods Enzymol* 154:329-350 (1987); Zoller and Smith, (1982) *Nucleic Acids Res* 10:6487-6500), phosphorothioate-modified DNA mutagenesis (Taylor, et al., (1985) *Nucl Acids Res* 13:8749-8764; Taylor, et al., (1985) *Nucl Acids Res* 13:8765-8787 (1985); Nakamaye and Eckstein, (1986) *Nucl Acids Res* 14:9679-9698; Sayers, et al., (1988) *Nucl Acids Res* 16:791-802 and Sayers, et al., (1988) *Nucl Acids Res* 16:803-814); mutagenesis using gapped duplex DNA (Kramer, et al., (1984) *Nucl Acids Res* 12:9441-9456; Kramer and Fritz, (1987) *Methods Enzymol* 154:350-367; Kramer, et al., (1988) *Nucl Acids Res* 16:7207 and Fritz, et al., (1988) *Nucl Acids Res* 16:6987-6999).

Additional suitable methods include point mismatch repair (Kramer, et al., (1984) *Cell* 38:879-887), mutagenesis using repair-deficient host strains (Carter, et al., (1985) *Nucl Acids Res* 13:4431-4443 and Carter, (1987) *Methods in Enzymol* 154:382-403), deletion mutagenesis (Eghtedarzadeh and Henikoff, (1986) *Nucl Acids Res* 14:5115), restriction-selection and restriction-purification (Wells, et al., (1986) *Phil Trans R Soc Lond* A 317:415-423), mutagenesis by total gene synthesis (Nambiar, et al., (1984) *Science* 223:1299-1301; Sakamar and Khorana, (1988) *Nucl Acids Res* 14:6361-6372; Wells, et al., (1985) *Gene* 34:315-323 and Grundström, et al., (1985) *Nucl Acids Res* 13:3305-3316), double-strand break repair (Mandecki, (1986) *PNAS USA*, 83:7177-7181 and Arnold, (1993) *Curr Opin Biotech* 4:450-455). Additional details on many of the above methods can be found in *Methods Enzymol* Volume 154, which also describes useful controls for trouble-shooting problems with various mutagenesis methods.

Additional details regarding various diversity generating methods can be found in the following U.S. patents, PCT Publications and Applications and EPO publications: U.S. Pat. Nos. 5,723,323, 5,763,192, 5,814,476, 5,817,483, 5,824,514, 5,976,862, 5,605,793, 5,811,238, 5,830,721, 5,834,252, 5,837,458, WO 1995/22625, WO 1996/33207, WO 1997/20078, WO 1997/35966, WO 1999/41402, WO 1999/41383, WO 1999/41369, WO 1999/41368, EP 752, 008, EP 0932670, WO 1999/23107, WO 1999/21979, WO 1998/31837, WO 1998/27230, WO 1998/27230, WO 2000/00632, WO 2000/09679, WO 1998/42832, WO 1999/29902, WO 1998/41653, WO 1998/41622, WO 1998/42727, WO 2000/18906, WO 2000/04190, WO 2000/42561, WO 2000/42559, WO 2000/42560, WO 2001/23401 and PCT/US01/06775.

The nucleotide sequences of the embodiments can also be used to isolate corresponding sequences from plants, including but not limited to ferns and other primitive plants. In this manner, methods such as PCR, hybridization, and the like can be used to identify such sequences based on their sequence homology to the sequences set forth herein. Sequences that are selected based on their sequence identity to the entire sequences set forth herein or to fragments thereof are encompassed by the embodiments. Such sequences include sequences that are orthologs of the disclosed sequences. The term "orthologs" refers to genes derived from a common ancestral gene and which are found in different species as a result of speciation. Genes found in different species are considered orthologs when their nucleotide sequences and/or their encoded protein sequences share substantial identity as defined elsewhere herein. Functions of orthologs are often highly conserved among species.

In a PCR approach, oligonucleotide primers can be designed for use in PCR reactions to amplify corresponding DNA sequences from cDNA or genomic DNA extracted from any organism of interest. Methods for designing PCR primers and PCR cloning are generally known in the art and are disclosed in Sambrook, et al., (1989) *Molecular Clon-*

*ing: A Laboratory Manual* (2d ed., Cold Spring Harbor Laboratory Press, Plainview, N.Y.), hereinafter "Sambrook". See also, Innis, et al., eds. (1990) *PCR Protocols: A Guide to Methods and Applications* (Academic Press, New York); Innis and Gelfand, eds. (1995) *PCR Strategies* (Academic Press, New York); and Innis and Gelfand, eds. (1999) *PCR Methods Manual* (Academic Press, New York). Known methods of PCR include, but are not limited to, methods using paired primers, nested primers, single specific primers, degenerate primers, gene-specific primers, vector-specific primers, partially-mismatched primers, and the like.

To identify potential IPD079 polypeptides from fern, moss or other primitive plant collections, the fern, moss or other primitive plant cell lysates can be screened with antibodies generated against an IPD079 polypeptides and/or IPD079 polypeptides using Western blotting and/or ELISA methods. This type of assays can be performed in a high throughput fashion. Positive samples can be further analyzed by various techniques such as antibody based protein purification and identification. Methods of generating antibodies are well known in the art as discussed infra.

Alternatively, mass spectrometry based protein identification method can be used to identify homologs of IPD079 polypeptides using protocols in the literatures (Scott Patterson, (1998), 10.22, 1-24, Current Protocol in Molecular Biology published by John Wiley & Son Inc.). Specifically, LC-MS/MS based protein identification method is used to associate the MS data of given cell lysate or desired molecular weight enriched samples (excised from SDS-PAGE gel of relevant molecular weight bands to IPD079 polypeptides) with sequence information of IPD079 polypeptides of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, and their homologs. Any match in peptide sequences indicates the potential of having the homologous proteins in the samples. Additional techniques (protein purification and molecular biology) can be used to isolate the protein and identify the sequences of the homologs.

In hybridization methods, all or part of the pesticidal nucleic acid sequence can be used to screen cDNA or genomic libraries. Methods for construction of such cDNA and genomic libraries are generally known in the art and are disclosed in Sambrook and Russell, (2001), supra. The so-called hybridization probes may be genomic DNA fragments, cDNA fragments, RNA fragments or other oligonucleotides and may be labeled with a detectable group such as 32P or any other detectable marker, such as other radioisotopes, a fluorescent compound, an enzyme or an enzyme co-factor. Probes for hybridization can be made by labeling synthetic oligonucleotides based on the known IPD079 polypeptide-encoding nucleic acid sequence disclosed herein. Degenerate primers designed on the basis of conserved nucleotides or amino acid residues in the nucleic acid sequence or encoded amino acid sequence can additionally be used. The probe typically comprises a region of nucleic acid sequence that hybridizes under stringent conditions to at least about 12, at least about 25, at least about 50, 75, 100, 125, 150, 175 or 200 consecutive nucleotides of nucleic acid sequence encoding an IPD079 polypeptide of the disclosure or a fragment or variant thereof. Methods for the preparation of probes for hybridization are generally known in the art and are disclosed in Sambrook and Russell, (2001), supra, herein incorporated by reference.

For example, an entire nucleic acid sequence, encoding an IPD079 polypeptide, disclosed herein or one or more portions thereof may be used as a probe capable of specifically hybridizing to corresponding nucleic acid sequences encoding IPD079 polypeptide-like sequences and messenger RNAs. To achieve specific hybridization under a variety of conditions, such probes include sequences that are unique and are preferably at least about 10 nucleotides in length or at least about 20 nucleotides in length. Such probes may be used to amplify corresponding pesticidal sequences from a chosen organism by PCR. This technique may be used to isolate additional coding sequences from a desired organism or as a diagnostic assay to determine the presence of coding sequences in an organism. Hybridization techniques include hybridization screening of plated DNA libraries (either plaques or colonies; see, for example, Sambrook, et al., (1989) Molecular Cloning: A Laboratory Manual (2d ed., Cold Spring Harbor Laboratory Press, Cold Spring Harbor, N.Y.).

Hybridization of such sequences may be carried out under stringent conditions. "Stringent conditions" or "stringent hybridization conditions" is used herein to refer to conditions under which a probe will hybridize to its target sequence to a detectably greater degree than to other sequences (e.g., at least 2-fold over background). Stringent conditions are sequence-dependent and will be different in different circumstances. By controlling the stringency of the hybridization and/or washing conditions, target sequences that are 100% complementary to the probe can be identified (homologous probing). Alternatively, stringency conditions can be adjusted to allow some mismatching in sequences so that lower degrees of similarity are detected (heterologous probing). Generally, a probe is less than about 1,000 nucleotides in length, preferably less than 500 nucleotides in length Proteins and Variants and Fragments Thereof Plant derived perforins and IPD079 polypeptides are also encompassed by the disclosure. "Plant derived perforins" as used herein refers to a polypeptide isolated from a plant or identified by proteomics from a plant genome or transcriptome comprising a MAC/Perforin (MACPF) Pfam domain (PF01823) or a variant thereof. "IPD079 polypeptide", and "IPD079 protein" as used herein interchangeably refers to a plant derived perforin polypeptide having insecticidal activity including but not limited to insecticidal activity against one or more insect pests of the Lepidoptera and/or Coleoptera orders, and is sufficiently homologous to the protein of SEQ ID NO: 2 or SEQ ID NO: 56. A variety of IPD079 polypeptides are contemplated. In some embodiments the IPD079 polypeptide is derived from a fern species in the Division Pteridophyta. Sources of plant derived perforins and IPD079 polypeptides or related proteins are from plants species selected from but not limited to *Adiantum, Adonis, Aglaomorpha, Asparagus, Asplenium, Bignonia, Blechnum,*

*Bolbitis, Campyloneurum, Celosia, Cissus, Colysis, Davallia, Didymochlaena, Doellingeria, Dryopteris, Elaphoglossum, Equisetum, Hedera, Huperzia, Lycopodium, Lygodium, Marsilea, Matteuccia, Microsorum, Nephrolepis, Onoclea, Ophioglossum, Pandorea, Pellaea, Phormium, Platycerium, Polypodium, Polystichium, Prostanthera, Psilotum, Pteris, Rumohra, Schizophragma, Selaginella, Sphaeropteris, Stenochiaena, Symphoricarpos, Thelypteris, Tupidanthus, Verbascum, Vernonia,* and *Waldsteinia* species. Sources of plant derived perforins and IPD079 polypeptides or related proteins are ferns and other primitive plant species selected from but not limited to *Huperzia, Ophioglossum, Lycopodium,* and *Platycerium* species. "IPD094 polypeptide", and "IPD094 protein" as used herein interchangeably refers to a plant derived perforin polypeptide having insecticidal activity including but not limited to insecticidal activity against one or more insect pests of the Lepidoptera and/or Coleoptera orders, and is sufficiently homologous to the protein of SEQ ID NO: 144.

"Sufficiently homologous" is used herein to refer to an amino acid sequence that has at least about 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence homology compared to a reference sequence using one of the alignment programs described herein using standard parameters. The term "about" when used herein in context with percent sequence identity means +/−0.5%. In some embodiments the sequence homology is against the full length sequence of the polypeptide. One of skill in the art will recognize that these values can be appropriately adjusted to determine corresponding homology of proteins taking into account amino acid similarity and the like. In some embodiments the sequence identity is calculated using ClustalW algorithm in the ALIGNX® module of the Vector NTI® Program Suite (Invitrogen Corporation, Carlsbad, Calif.) with all default parameters. In some embodiments the sequence identity is across the entire length of polypeptide calculated using ClustalW algorithm in the ALIGNX® module of the Vector NTI® Program Suite (Invitrogen Corporation, Carlsbad, Calif.) with all default parameters.

As used herein, the terms "protein," "peptide molecule," or "polypeptide" includes any molecule that comprises five or more amino acids. It is well known in the art that protein, peptide or polypeptide molecules may undergo modification, including post-translational modifications, such as, but not limited to, disulfide bond formation, glycosylation, phosphorylation or oligomerization. Thus, as used herein, the terms "protein," "peptide molecule" or "polypeptide" includes any protein that is modified by any biological or non-biological process. The terms "amino acid" and "amino acids" refer to all naturally occurring L-amino acids.

A "recombinant protein" is used herein to refer to a protein that is no longer in its natural environment, for example in vitro or in a recombinant bacterial or plant host cell. A polypeptide that is substantially free of cellular material includes preparations of protein having less than about 30%, 20%, 10% or 5% (by dry weight) of non-pesticidal protein (also referred to herein as a "contaminating protein").

"Fragments" or "biologically active portions" include polypeptide fragments comprising amino acid sequences sufficiently identical to the polypeptide and that exhibit insecticidal activity. Such biologically active portions can be prepared by recombinant techniques and evaluated for insecticidal activity.

"Variants" as used herein refers to proteins or polypeptides having an amino acid sequence that is at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98% or 99% identical to the parental amino acid sequence. Variants can be in the form of amino acid substitutions; deletions, including but not limited to deletion of amino acids at the N-terminus and/or C-terminus; and additions, including but not limited to N-terminal and/or C-terminal, compared to the native polypeptide.

Plant Derived Perforins

In some embodiments the plant derived perforin comprises a MAC/Perforin (MACPF) Pfam domain (PF01823). In some embodiments the plant derived perforins is identified using proteomic methods known to one skilled in the art. In some embodiments the plant derived perforins is identified by BLAST and/or HMMSearch. In some embodiments the plant derived perforins matched the profile HMM of Pfam ID #IPR020864 with an E-value of less than 0.01 and having a length of greater than 250 amino acids. In some embodiments the plant derived perforin has at least 90%, 91%, 92%, 93%, 94%, 95%, 96%, 97%, 98%, 99% or greater amino acid sequence identity to any one of SEQ ID NOs: 158-1248. In some embodiments the plant derived perforin comprises the amino acid sequence of the polypeptide of any one of SEQ ID NOs: 158-1248, homologs thereof or variants thereof. In some embodiments the plant derived perforin has at least 90%, 91%, 92%, 93%, 94%, 95%, 96%, 97%, 98%, 99% or greater amino acid sequence identity to IPD094 polypeptide of SEQ ID NO: 144. In some embodiments the plant derived perforin is an IPD094 polypeptide of the disclosure, homologs thereof or variants thereof. In some embodiments the plant derived perforin is an IPD079 polypeptide of the disclosure.

IPD079 Polypeptides

In some embodiments an IPD079 polypeptide comprises an amino acid sequence having at least 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138 or SEQ ID NO: 140, wherein the IPD079 polypeptide has insecticidal activity.

In some embodiments an IPD079 polypeptide comprises an amino acid sequence having at least 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92 or SEQ ID NO: 94, wherein the IPD079 polypeptide has insecticidal activity.

In some embodiments an IPD079 polypeptide comprises an amino acid sequence having at least 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138 or SEQ ID NO: 140, wherein the IPD079 polypeptide has insecticidal activity.

In some embodiments an IPD079 polypeptide comprises an amino acid sequence having at least about 80%, 81%, 82%, 83%, 84%, 85%, 86%, 87%, 88%, 89%, 90%, 91%, 92%, 93%, 94%, 95%, 96%, 97%, 98% or 99% identity across the entire length of the amino acid sequence of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92 or SEQ ID NO: 94.

In some embodiments an IPD079 polypeptide comprises an amino acid sequence having at least about 80%, 81%, 82%, 83%, 84%, 85%, 86%, 87%, 88%, 89%, 90%, 91%, 92%, 93%, 94%, 95%, 96%, 97%, 98% or 99% identity across the entire length of the amino acid sequence of SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138 or SEQ ID NO: 140.

In some embodiments an IPD079 polypeptide comprises an amino acid sequence of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92 or SEQ ID NO: 94 having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70 or more amino acid substitutions compared to the native amino acid at the corresponding position of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92 or SEQ ID NO: 94.

In some embodiments an IPD079 polypeptide comprises an amino acid sequence of SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138 or SEQ ID NO: 140 having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70 or more amino acid substitutions compared to the native amino acid at the corresponding position of SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138 or SEQ ID NO: 140.

In some embodiments the sequence identity is across the entire length of the polypeptide calculated using ClustalW algorithm in the ALIGNX® module of the Vector NTI® Program Suite (Invitrogen Corporation, Carlsbad, Calif.) with all default parameters.

In some embodiments the IPD079 polypeptide comprises an amino acid sequence of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92 or SEQ ID NO: 94.

In some embodiments the IPD079 polypeptide comprises an amino acid sequence of SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138 or SEQ ID NO: 140.

Fragment or biologically active portions of IPD079 polypeptides includes fragments comprising amino acid sequences sufficiently identical to the amino acid sequence set forth in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138 or SEQ ID NO: 140, wherein the IPD079 polypeptide has insecticidal activity. Such biologically active portions can be prepared by recombinant techniques and evaluated for insecticidal activity.

In some embodiments, the IPD079 polypeptide fragment is an N-terminal and/or a C-terminal truncation of at least about 1, 2, 3, 4, 5, 6, 7, 8, 9, 10, 11, 12, 13, 14, 15, 16, 17, 18, 19, 20, 25, 26, 27, 28, 29, 30, 31, 32, 33, 34 or more amino acids from the N-terminus and/or C-terminus relative to SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138 or SEQ ID NO: 140, e.g., by proteolysis, by insertion of a start codon, by deletion of the codons encoding the deleted amino acids and concomitant insertion of a start codon, and/or insertion of a stop codon.

Phylogenetic, Sequence Motif, and Structural Analyses for Insecticidal Protein Families A sequence and structure analysis method can be employed and may be composed of four components: phylogenetic tree construction, protein sequence motifs finding, secondary structure prediction, and alignment of protein sequences and secondary structures. Details about each component are illustrated below.

1) Phylogenetic Tree Construction

The phylogenetic analysis can be performed using the software MEGA5. Protein sequences were subjected to ClustalW version 2 analysis (Larkin M. A et al (2007) *Bioinformatics* 23(21): 2947-2948) for multiple sequence alignment. The evolutionary history is then inferred by the Maximum Likelihood method based on the JTT matrix-based model. The tree with the highest log likelihood is obtained, exported in Newick format, and further processed to extract the sequence IDs in the same order as they appeared in the tree. A few clades representing sub-families can be manually identified for each insecticidal protein family.

2) Protein Sequence Motifs Finding

Protein sequences are re-ordered according to the phylogenetic tree built previously, and fed to the MOTIF analysis tool MEME (Multiple EM for MOTIF Elicitation) (Bailey T. L., and Elkan C., *Proceedings of the Second International Conference on Intelligent Systems for Molecular Biology*, pp. 28-36, AAAI Press, Menlo Park, Calif., 1994.) for identification of key sequence motifs. MEME is setup as follows: Minimum number of sites 2, Minimum motif width 5, and Maximum number of motifs 30. Sequence motifs unique to each sub-family were identified by visual observation. The distribution of MOTIFs across the entire gene family could be visualized in HTML webpage. The MOTIFs are numbered relative to the ranking of the E-value for each MOTIF.

3) Secondary Structure Prediction

PSIPRED, top ranked secondary structure prediction method (Jones D T. (1999) *J. Mol. Biol.* 292: 195-202), can be installed in a local Linux server, and used for protein secondary structure prediction. The tool provides accurate structure prediction using two feed-forward neural networks based on the PSI-BLAST output. The PSI-BLAST database is created by removing low-complexity, transmembrane, and coiled-coil regions in Uniref100. The PSIPRED results contain the secondary structures (Alpha helix: H, Beta strand: E, and Coil: C) and the corresponding confidence scores for each amino acid in a given protein sequence.

4) Alignment of Protein Sequences and Secondary Structures

A script can be developed to generate gapped secondary structure alignment according to the multiple protein sequence alignment from step 1 for all proteins. All aligned protein sequences and structures are concatenated into a single FASTA file, and then imported into MEGA for visualization and identification of conserved structures.

In some embodiments an IPD079 polypeptide has a calculated molecular weight of between about 30 kD and about 70 kD, between about 40 kD and about 60 kD, between about 45 kD and about 55 kD, and between about 47.5 kD and about 52.5 kD. "About" with respect to molecular weight means ±1 kD.

In some embodiments the IPD079 polypeptide has a modified physical property. As used herein, the term "physical property" refers to any parameter suitable for describing the physical-chemical characteristics of a protein. As used herein, "physical property of interest" and "property of interest" are used interchangeably to refer to physical properties of proteins that are being investigated and/or modified. Examples of physical properties include, but are not limited to net surface charge and charge distribution on the protein surface, net hydrophobicity and hydrophobic residue distribution on the protein surface, surface charge density, surface hydrophobicity density, total count of surface ionizable groups, surface tension, protein size and its distribution in solution, melting temperature, heat capacity, and second virial coefficient. Examples of physical properties also include, but are not limited to solubility, folding, stability, and digestibility. In some embodiments the IPD079 polypeptide has increased digestibility of proteolytic fragments in an insect gut. Models for digestion by simulated gastric fluids are known to one skilled in the art (Fuchs, R. L. and J. D. Astwood. *Food Technology* 50: 83-88, 1996; Astwood, J. D., et al *Nature Biotechnology* 14: 1269-1273, 1996; Fu T J et al *J. Agric Food Chem.* 50: 7154-7160, 2002).

In some embodiments variants include polypeptides that differ in amino acid sequence due to mutagenesis. Variant proteins encompassed by the disclosure are biologically active, that is they continue to possess the desired biological activity (i.e. pesticidal activity) of the native protein. In some embodiment the variant will have at least about 10%, at least about 30%, at least about 50%, at least about 70%, at least about 80% or more of the insecticidal activity of the native protein. In some embodiments, the variants may have improved activity over the native protein.

Bacterial genes quite often possess multiple methionine initiation codons in proximity to the start of the open reading frame. Often, translation initiation at one or more of these start codons will lead to generation of a functional protein. These start codons can include ATG codons. However, bacteria such as *Bacillus* sp. also recognize the codon GTG as a start codon, and proteins that initiate translation at GTG codons contain a methionine at the first amino acid. On rare occasions, translation in bacterial systems can initiate at a TTG codon, though in this event the TTG encodes a methionine. Furthermore, it is not often determined a priori which of these codons are used naturally in the bacterium. Thus, it is understood that use of one of the alternate methionine codons may also lead to generation of pesticidal proteins. These pesticidal proteins are encompassed in the present disclosure and may be used in the methods of the present disclosure. It will be understood that, when expressed in plants, it will be necessary to alter the alternate start codon to ATG for proper translation.

One skilled in the art understands that the polynucleotide coding sequence can be modified to add a codon at the penultimate position following the methionine start codon to create a restriction enzyme site for recombinant cloning purposes and/or for expression purposes. In some embodiments the IPD079 polypeptide further comprises an alanine residue at the penultimate position following the translation initiator methionine.

In some embodiments the translation initiator methionine of the IPD079 polypeptide is cleaved off post translationally. One skilled in the art understands that the N-terminal translation initiator methionine can be removed by methionine aminopeptidase in many cellular expression systems.

In another embodiment the plant derived perforins including but not limited to the IPD079 polypeptide may be expressed as a precursor protein with an intervening sequence that catalyzes multi-step, post translational protein splicing. Protein splicing involves the excision of an intervening sequence from a polypeptide with the concomitant joining of the flanking sequences to yield a new polypeptide (Chong, et al., (1996) *J. Biol. Chem.*, 271:22159-22168). This intervening sequence or protein splicing element, referred to as inteins, which catalyze their own excision through three coordinated reactions at the N-terminal and C-terminal splice junctions: an acyl rearrangement of the N-terminal cysteine or serine; a transesterification reaction between the two termini to form a branched ester or thioester intermediate and peptide bond cleavage coupled to cyclization of the intein C-terminal asparagine to free the intein (Evans, et al., (2000) *J. Biol. Chem.*, 275:9091-9094. The elucidation of the mechanism of protein splicing has led to a number of intein-based applications (Comb, et al., U.S. Pat. No. 5,496,714; Comb, et al., U.S. Pat. No. 5,834,247; Camarero and Muir, (1999) *J. Amer. Chem. Soc.* 121:5597-5598; Chong, et al., (1997) *Gene* 192:271-281, Chong, et al., (1998) *Nucleic Acids Res.* 26:5109-5115; Chong, et al., (1998) *J. Biol. Chem.* 273:10567-10577; Cotton, et al., (1999) *J. Am. Chem. Soc.* 121:1100-1101; Evans, et al., (1999) *J. Biol. Chem.* 274:18359-18363; Evans, et al., (1999) *J. Biol. Chem.* 274:3923-3926; Evans, et al., (1998) *Protein Sci.* 7:2256-2264; Evans, et al., (2000) *J. Biol. Chem.* 275:9091-9094; Iwai and Pluckthun, (1999) *FEBS Lett.* 459:166-172; Mathys, et al., (1999) *Gene* 231:1-13; Mills, et al., (1998) *Proc. Natl. Acad. Sci. USA* 95:3543-3548; Muir, et al., (1998) *Proc. Natl. Acad. Sci. USA* 95:6705-6710; Otomo, et al., (1999) *Biochemistry* 38:16040-16044; Otomo, et al., (1999) *J. Biolmol. NMR* 14:105-114; Scott, et al., (1999) *Proc. Natl. Acad. Sci. USA* 96:13638-13643; Severinov and Muir, (1998) *J. Biol. Chem.* 273:16205-16209; Shingledecker, et al., (1998) *Gene* 207: 187-195; Southworth, et al., (1998) *EMBO J.* 17:918-926; Southworth, et al., (1999) *Biotechniques* 27:110-120; Wood, et al., (1999) *Nat. Biotechnol.* 17:889-892; Wu, et al., (1998a) *Proc. Natl. Acad. Sci. USA* 95:9226-9231; Wu, et al., (1998b) *Biochim Biophys Acta* 1387:422-432; Xu, et al., (1999) *Proc. Natl. Acad. Sci. USA* 96:388-393; Yamazaki, et al., (1998) *J. Am. Chem. Soc.*, 120:5591-5592). For the application of inteins in plant transgenes, see, Yang, et al., (*Transgene Res* 15:583-593 (2006)) and Evans, et al., (*Annu. Rev. Plant Biol.* 56:375-392 (2005)).

In another embodiment the plant derived perforin, including but not limited to a IPD079 polypeptide, may be encoded by two separate genes where the intein of the precursor protein comes from the two genes, referred to as a split-intein, and the two portions of the precursor are joined by a peptide bond formation. This peptide bond formation is accomplished by intein-mediated trans-splicing. For this purpose, a first and a second expression cassette comprising the two separate genes further code for inteins capable of mediating protein trans-splicing. By trans-splicing, the proteins and polypeptides encoded by the first and second fragments may be linked by peptide bond formation. Trans-splicing inteins may be selected from the nucleolar and organellar genomes of different organisms including eukaryotes, archaeabacteria and eubacteria. Inteins that may be used for are listed at neb.com/neb/inteins.html, which can be accessed on the world-wide web using the "www" prefix). The nucleotide sequence coding for an intein may be split into a 5' and a 3' part that code for the 5' and the 3' part of the intein, respectively. Sequence portions not necessary for intein splicing (e.g. homing endonuclease domain) may be deleted. The intein coding sequence is split such that the 5' and the 3' parts are capable of trans-splicing. For selecting a suitable splitting site of the intein coding sequence, the considerations published by Southworth, et al., (1998) *EMBO J.* 17:918-926 may be followed. In constructing the first and the second expression cassette, the 5' intein coding sequence is linked to the 3' end of the first fragment coding for the N-terminal part of the IPD079 polypeptide and the 3' intein coding sequence is linked to the 5' end of the second fragment coding for the C-terminal part of the IPD079 polypeptide.

In general, the trans-splicing partners can be designed using any split intein, including any naturally-occurring or artificially-split split intein. Several naturally-occurring split inteins are known, for example: the split intein of the DnaE gene of *Synechocystis* sp. PCC6803 (see, Wu, et al., (1998) *Proc Natl Acad Sci USA.* 95(16):9226-31 and Evans, et al., (2000) *J Biol Chem.* 275(13):9091-4 and of the DnaE gene from *Nostoc punctiforme* (see, Iwai, et al., (2006) *FEBS Lett.* 580(7):1853-8). Non-split inteins have been artificially split in the laboratory to create new split inteins, for example: the artificially split Ssp DnaB intein (see, Wu, et al., (1998) *Biochim Biophys Acta.* 1387:422-32) and split Sce VMA intein (see, Brenzel, et al., (2006) *Biochemistry.* 45(6):1571-8) and an artificially split fungal mini-intein (see, Elleuche, et al., (2007) *Biochem Biophys Res Commun.* 355(3):830-4). There are also intein databases available that catalogue known inteins (see for example the online-database available at: bioinformatics.weizmann.ac.il/~pietro/inteins/Inteinstable.html, which can be accessed on the world-wide web using the "www" prefix).

Naturally-occurring non-split inteins may have endonuclease or other enzymatic activities that can typically be removed when designing an artificially-split split intein. Such mini-inteins or minimized split inteins are well known in the art and are typically less than 200 amino acid residues long (see, Wu, et al., (1998) *Biochim Biophys Acta.* 1387:422-32). Suitable split inteins may have other purification enabling polypeptide elements added to their structure, provided that such elements do not inhibit the splicing of the split intein or are added in a manner that allows them to be removed prior to splicing. Protein splicing has been reported using proteins that comprise bacterial intein-like (BIL) domains (see, Amitai, et al., (2003) *Mol Microbiol.* 47:61-73) and hedgehog (Hog) auto-processing domains (the latter is combined with inteins when referred to as the Hog/intein superfamily or HINT family (see, Dassa, et al., (2004) *J Biol Chem.* 279:32001-7) and domains such as these may also be used to prepare artificially-split inteins. In particular, non-splicing members of such families may be modified by molecular biology methodologies to introduce or restore splicing activity in such related species. Recent studies demonstrate that splicing can be observed when a N-terminal split intein component is allowed to react with a C-terminal split intein component not found in nature to be its "partner"; for example, splicing has been observed utilizing partners that have as little as 30 to 50% homology with the "natural" splicing partner (see, Dassa, et al., (2007) *Biochemistry.* 46(1):322-30). Other such mixtures of disparate split intein partners have been shown to be unreactive one with another (see, Brenzel, et al., (2006) *Biochemistry.* 45(6):1571-8). However, it is within the ability of a person skilled in the relevant art to determine whether a particular pair of polypeptides is able to associate with each other to provide a functional intein, using routine methods and without the exercise of inventive skill.

In another embodiment the plant derived perforins, including but not limited to an IPD079 polypeptide, is a circular permuted variant. In certain embodiments the IPD079 polypeptide is a circular permuted variant of the polypeptide of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, or SEQ ID NO: 140.

The development of recombinant DNA methods has made it possible to study the effects of sequence transposition on protein folding, structure and function. The approach used in creating new sequences resembles that of naturally occurring pairs of proteins that are related by linear reorganization of their amino acid sequences (Cunningham, et al., (1979) *Proc. Natl. Acad. Sci. U.S.A.* 76:3218-3222; Teather and Erfle, (1990) *J. Bacteriol.* 172:3837-3841; Schimming, et al., (1992) *Eur. J. Biochem.* 204:13-19; Yamiuchi and Minamikawa, (1991) *FEBS Lett.* 260:127-130; MacGregor, et al., (1996) *FEBS Lett.* 378:263-266). The first in vitro application of this type of rearrangement to proteins was described by Goldenberg and Creighton (*J. Mol. Biol.* 165:407-413, 1983). In creating a circular permuted variant a new N-terminus is selected at an internal site (breakpoint) of the original sequence, the new sequence having the same order of amino acids as the original from the breakpoint until it reaches an amino acid that is at or near the original C-terminus. At this point the new sequence is joined, either directly or through an additional portion of sequence (linker), to an amino acid that is at or near the original N-terminus and the new sequence continues with the same sequence as the original until it reaches a point that is at or near the amino acid that was N-terminal to the breakpoint site of the original sequence, this residue forming the new C-terminus of the chain. The length of the amino acid sequence of the linker can be selected empirically or with guidance from structural information or by using a combination of the two approaches. When no structural information is available, a small series of linkers can be prepared for testing using a design whose length is varied in order to span a range from 0 to 50 Å and whose sequence is chosen in order to be consistent with surface exposure (hydrophilicity, Hopp and Woods, (1983) *Mol. Immunol.* 20:483-489; Kyte and Doolittle, (1982) *J. Mol. Biol.* 157:105-132; solvent exposed surface area, Lee and Richards, (1971) *J. Mol. Biol.* 55:379-400) and the ability to adopt the necessary conformation without deranging the configuration of the pesticidal polypeptide (conformationally flexible; Karplus and Schulz, (1985) *Naturwissenschaften* 72:212-213). Assuming an average of translation of 2.0 to 3.8 Å per residue, this would mean the length to test would be between 0 to 30 residues, with 0 to 15 residues being the preferred range. Exemplary of such an empirical series would be to construct linkers using a cassette sequence such as Gly-Gly-Gly-Ser repeated n times, where n is 1, 2, 3 or 4. Those skilled in the art will recognize that there are many such sequences that vary in length or composition that can serve as linkers with the primary consideration being that they be neither excessively long nor short (cf., Sandhu, (1992) *Critical Rev. Biotech.* 12:437-462); if they are too long, entropy effects will likely destabilize the three-dimensional fold, and may also make folding kinetically impractical, and if they are too short, they will likely destabilize the molecule because of torsional or steric strain. Those skilled in the analysis of protein structural information will recognize that using the distance between the chain ends, defined as the distance between the c-alpha carbons, can be used to define the length of the sequence to be used or at least to limit the number of possibilities that must be tested in an empirical selection of linkers. They will also recognize that it is sometimes the case that the positions of the ends of the polypeptide chain are ill-defined in structural models derived from x-ray diffraction or nuclear magnetic resonance spectroscopy data, and that when true, this situation will therefore need to be taken into account in order to properly estimate the length of the linker required. From those residues whose positions are well defined are selected two residues that are close in sequence to the chain ends, and the distance between their c-alpha carbons is used to calculate an approximate length for a linker between them. Using the calculated length as a guide, linkers with a range of number of residues (calculated using 2 to 3.8 Å per residue) are then selected. These linkers may be composed of the original sequence, shortened or lengthened as necessary, and when lengthened the additional residues may be chosen to be flexible and hydrophilic as described above; or optionally the original sequence may be substituted for using a series of linkers, one example being the Gly-Gly-Gly-Ser cassette approach mentioned above; or optionally a combination of the original sequence and new sequence having the appropriate total length may be used. Sequences of pesticidal polypeptides capable of folding to biologically active states can be prepared by appropriate selection of the beginning (amino terminus) and ending (carboxyl terminus) positions from within the original polypeptide chain while using the linker sequence as described above. Amino and carboxyl termini are selected from within a common stretch of sequence, referred to as a breakpoint region, using the guidelines described below. A novel amino acid sequence is thus generated by selecting amino and carboxyl termini from within the same breakpoint region. In many cases the selection of the new termini will be such that the original position of the carboxyl terminus immediately preceded that of the amino terminus. However, those skilled in the art will recognize that selections of termini anywhere within the region may function, and that these will effectively lead to either deletions or additions to the amino or carboxyl portions of the new sequence. It is a central tenet of molecular biology that the primary amino acid sequence of a protein dictates folding to the three-dimensional structure necessary for expression of its biological function. Methods are known to those skilled in the art to obtain and interpret three-dimensional structural information using x-ray diffraction of single protein Crystals or nuclear magnetic resonance spectroscopy of protein solutions. Examples of structural information that are relevant to the identification of breakpoint regions include the location and type of protein secondary structure (alpha and 3-10 helices, parallel and anti-parallel beta sheets, chain reversals and turns, and loops; Kabsch and Sander, (1983) *Biopolymers* 22:2577-2637; the degree of solvent exposure of amino acid residues, the extent and type of interactions of residues with one another (Chothia, (1984) *Ann. Rev. Biochem.* 53:537-572) and the static and dynamic distribution of conformations along the polypeptide chain (Alber and Mathews, (1987) *Methods Enzymol.* 154:511-533). In some cases additional information is known about solvent exposure of residues; one example is a site of post-translational attachment of carbohydrate which is necessarily on the surface of the protein. When experimental structural information is not available or is not feasible to obtain, methods are also available to analyze the primary amino acid sequence in order to make predictions of protein tertiary and secondary structure, solvent accessibility and the occurrence of turns and loops. Biochemical methods are also sometimes applicable for empirically determining surface exposure when direct structural methods are not feasible; for example, using the identification of sites of chain scission following limited proteolysis in order to infer surface exposure (Gentile and Salvatore, (1993) *Eur. J. Biochem.* 218:603-621). Thus using either the experimentally derived structural information or predictive methods (e.g., Srinivisan and Rose, (1995) *Proteins: Struct., Fund. & Genetics* 22:81-99) the parental amino acid sequence is inspected to classify regions according to whether or not they are integral to the maintenance of secondary and tertiary structure. The occurrence of sequences within regions that are known to be involved in periodic secondary structure (alpha and 3-10 helices, parallel and anti-parallel beta sheets) are regions that should be avoided. Similarly, regions of amino acid sequence that are observed or predicted to have a low degree of solvent exposure are more likely to be part of the so-called hydrophobic core of the protein and should also be avoided for selection of amino and carboxyl termini. In contrast, those regions that are known or predicted to be in surface turns or loops, and especially those regions that are known not to be required for biological activity, are the preferred sites for location of the extremes of the polypeptide chain. Continuous stretches of amino acid sequence that are preferred based on the above criteria are referred to as a breakpoint region. Polynucleotides encoding circular permuted IPD079 polypeptides with new N-terminus/C-terminus which contain a linker region separating the original C-terminus and N-terminus can be made essentially following the method described in Mullins, et al., (1994) *J. Am. Chem. Soc.* 116:5529-5533. Multiple steps of polymerase chain reaction (PCR) amplifications are used to rearrange the DNA sequence encoding the primary amino acid sequence of the protein. Polynucleotides encoding circular permuted IPD079 polypeptides with new N-terminus/C-terminus which contain a linker region separating the original C-terminus and N-terminus can be made based on the tandem-duplication method described in Horlick, et al., (1992)

*Protein Eng.* 5:427-431. Polymerase chain reaction (PCR) amplification of the new N-terminus/C-terminus genes is performed using a tandemly duplicated template DNA.

In another embodiment fusion proteins are provided comprising a plant derived perforins, including but not limited to the IPD079 polypeptides of the disclosure. In some embodiments the fusion proteins comprise an IPD079 polypeptide including but not limited to the polypeptide of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, or SEQ ID NO: 140, and active fragments thereof.

Methods for design and construction of fusion proteins (and polynucleotides encoding same) are known to those of skill in the art. Polynucleotides encoding a plant derived perforins or an IPD079 polypeptide may be fused to signal sequences which will direct the localization of the protein to particular compartments of a prokaryotic or eukaryotic cell and/or direct the secretion of the IPD079 polypeptide of the embodiments from a prokaryotic or eukaryotic cell. For example, in *E. coli*, one may wish to direct the expression of the protein to the periplasmic space. Examples of signal sequences or proteins (or fragments thereof) to which the IPD079 polypeptide may be fused in order to direct the expression of the polypeptide to the periplasmic space of bacteria include, but are not limited to, the pelB signal sequence, the maltose binding protein (MBP) signal sequence, MBP, the ompA signal sequence, the signal sequence of the periplasmic *E. coli* heat-labile enterotoxin B-subunit and the signal sequence of alkaline phosphatase. Several vectors are commercially available for the construction of fusion proteins which will direct the localization of a protein, such as the pMAL series of vectors (particularly the pMAL-p series) available from New England Biolabs. In a specific embodiment, the IPD079 polypeptide may be fused to the pelB pectate lyase signal sequence to increase the efficiency of expression and purification of such polypeptides in Gram-negative bacteria (see, U.S. Pat. Nos. 5,576,195 and 5,846,818). Plant plastid transit peptide/ polypeptide fusions are well known in the art (see, U.S. Pat. No. 7,193,133). Apoplast transit peptides such as rice or barley alpha-amylase secretion signal are also well known in the art. The plastid transit peptide is generally fused N-terminal to the polypeptide to be targeted (e.g., the fusion partner). In one embodiment, the fusion protein consists essentially of the plastid transit peptide and the IPD079 polypeptide to be targeted. In another embodiment, the fusion protein comprises the plastid transit peptide and the polypeptide to be targeted. In such embodiments, the plastid transit peptide is preferably at the N-terminus of the fusion protein. However, additional amino acid residues may be N-terminal to the plastid transit peptide providing that the fusion protein is at least partially targeted to a plastid. In a specific embodiment, the plastid transit peptide is in the N-terminal half, N-terminal third or N-terminal quarter of the fusion protein. Most or all of the plastid transit peptide is generally cleaved from the fusion protein upon insertion into the plastid. The position of cleavage may vary slightly between plant species, at different plant developmental stages, as a result of specific intercellular conditions or the particular combination of transit peptide/fusion partner used. In one embodiment, the plastid transit peptide cleavage is homogenous such that the cleavage site is identical in a population of fusion proteins. In another embodiment, the plastid transit peptide is not homogenous, such that the cleavage site varies by 1-10 amino acids in a population of fusion proteins. The plastid transit peptide can be recombinantly fused to a second protein in one of several ways. For example, a restriction endonuclease recognition site can be introduced into the nucleotide sequence of the transit peptide at a position corresponding to its C-terminal end and the same or a compatible site can be engineered into the nucleotide sequence of the protein to be targeted at its N-terminal end. Care must be taken in designing these sites to ensure that the coding sequences of the transit peptide and the second protein are kept "in frame" to allow the synthesis of the desired fusion protein. In some cases, it may be preferable to remove the initiator methionine codon of the second protein when the new restriction site is introduced. The introduction of restriction endonuclease recognition sites on both parent molecules and their subsequent joining through recombinant DNA techniques may result in the addition of one or more extra amino acids between the transit peptide and the second protein. This generally does not affect targeting activity as long as the transit peptide cleavage site remains accessible and the function of the second protein is not altered by the addition of these extra amino acids at its N-terminus. Alternatively, one skilled in the art can create a precise cleavage site between the transit peptide and the second protein (with or without its initiator methionine) using gene synthesis (Stemmer, et al., (1995) *Gene* 164:49-53) or similar methods. In addition, the transit peptide fusion can intentionally include amino acids downstream of the cleavage site. The amino acids at the N-terminus of the mature protein can affect the ability of the transit peptide to target proteins to plastids and/or the efficiency of cleavage following protein import. This may be dependent on the protein to be targeted. See, e.g., Comai, et al., (1988) *J. Biol. Chem.* 263(29):15104-9.

In some embodiments fusion proteins are provide comprising a plant derived perforin, including but not limited to an IPD079 polypeptide, and an insecticidal polypeptide joined by an amino acid linker. In some embodiments fusion proteins are provided represented by a formula selected from the group consisting of:

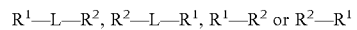

$R^1$—L—$R^2$, $R^2$—L—$R^1$, $R^1$—$R^2$ or $R^2$—$R^1$ wherein $R^1$ is a plant derived perforin or an IPD079 polypeptide, $R^2$ is a protein of interest. The $R^1$ polypeptide is fused either directly or through a linker (L) segment to the $R^2$ polypeptide. The term "directly" defines fusions in which the polypeptides are joined without a peptide linker. Thus "L" represents a chemical bound or polypeptide segment to which both $R^1$ and $R^2$ are fused in frame, most commonly L is a linear peptide to which $R^1$ and $R^2$ are bound by amide bonds linking the carboxy terminus of $R^1$ to the amino terminus of L and carboxy terminus of L to the amino terminus of $R^2$. By "fused in frame" is meant that there is no translation termination or disruption between the reading frames of $R^1$ and $R^2$. The linking group (L) is generally a polypeptide of between 1 and 500 amino acids in length. The linkers joining the two molecules are preferably designed to (1) allow the two molecules to fold and act independently of each other, (2) not have a propensity for developing an ordered secondary structure which could interfere with the functional domains of the two proteins, (3) have minimal hydrophobic or charged characteristic which could interact with the functional protein domains and (4) provide steric separation of $R^1$ and $R^2$ such that $R^1$ and $R^2$ could interact simultaneously with their corresponding receptors on a single cell. Typically surface amino acids in flexible protein regions include Gly, Asn and Ser. Virtually any permutation of amino acid sequences containing Gly, Asn and Ser would be expected to satisfy the above criteria for a linker sequence. Other neutral amino acids, such as Thr and Ala, may also be used in the linker sequence. Additional amino acids may also be included in the linkers due to the addition of unique restriction sites in the linker sequence to facilitate construction of the fusions.

In some embodiments the linkers comprise sequences selected from the group of formulas: $(Gly_3Ser)_n$, $(Gly_4Ser)_n$, $(Gly_5Ser)_n$, $(Gly_nSer)_n$ or $(AlaGlySer)_n$ where n is an integer. One example of a highly-flexible linker is the (GlySer)-rich spacer region present within the pIII protein of the filamentous bacteriophages, e.g. bacteriophages M13 or fd (Schaller, et al., 1975). This region provides a long, flexible spacer region between two domains of the pIII surface protein. Also included are linkers in which an endopeptidase recognition sequence is included. Such a cleavage site may be valuable to separate the individual components of the fusion to determine if they are properly folded and active in vitro. Examples of various endopeptidases include, but are not limited to, Plasmin, Enterokinase, Kallikerin, Urokinase, Tissue Plasminogen activator, clostripain, Chymosin, Collagenase, Russell's Viper Venom Protease, Postproline cleavage enzyme, V8 protease, Thrombin and factor Xa. In some embodiments the linker comprises the amino acids EEKKN (SEQ ID NO: 157) from the multi-gene expression vehicle (MGEV), which is cleaved by vacuolar proteases as disclosed in U.S. Patent Application Publication Number US 2007/0277263. In other embodiments, peptide linker segments from the hinge region of heavy chain immunoglobulins IgG, IgA, IgM, IgD or IgE provide an angular relationship between the attached polypeptides. Especially useful are those hinge regions where the cysteines are replaced with serines. Linkers of the present disclosure include sequences derived from murine IgG gamma 2b hinge region in which the cysteines have been changed to serines. The fusion proteins are not limited by the form, size or number of linker sequences employed and the only requirement of the linker is that functionally it does not interfere adversely with the folding and function of the individual molecules of the fusion.

In another embodiment chimeric IPD079 polypeptides are provided that are created through joining two or more portions of IPD079 genes, which originally encoded separate IPD079 proteins to create a chimeric gene. The translation of the chimeric gene results in a single chimeric IPD079 polypeptide with regions, motifs or domains derived from each of the original polypeptides. In certain embodiments the chimeric protein comprises portions, motifs or domains of IPD079 polypeptides of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, or SEQ ID NO: 140 in any combination.

It is recognized that DNA sequences may be altered by various methods, and that these alterations may result in DNA sequences encoding proteins with amino acid sequences different than that encoded by the wild-type (or native) pesticidal protein. In some embodiments an IPD079 polypeptide may be altered in various ways including amino acid substitutions, deletions, truncations and insertions of one or more amino acids, including up to 2, 3, 4, 5, 6, 7, 8, 9, 10, 15, 20, 25, 30, 35, 40, 45, 50, 55, 60, 65, 70, 75, 80, 85, 90, 100, 105, 110, 115, 120, 125, 130, 135, 140, 145 or more amino acid substitutions, deletions and/or insertions or combinations thereof compared to any one of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, or SEQ ID NO: 140.

Methods for such manipulations are generally known in the art. For example, amino acid sequence variants of an IPD079 polypeptide can be prepared by mutations in the DNA. This may also be accomplished by one of several forms of mutagenesis and/or in directed evolution. In some aspects, the changes encoded in the amino acid sequence will not substantially affect the function of the protein. Such variants will possess the desired pesticidal activity. However, it is understood that the ability of an IPD079 polypeptide to confer pesticidal activity may be improved by the use of such techniques upon the compositions of this disclosure.

For example, conservative amino acid substitutions may be made at one or more nonessential amino acid residues. A "nonessential" amino acid residue is a residue that can be altered from the wild-type sequence of an IPD079 polypeptide without altering the biological activity. A "conservative amino acid substitution" is one in which the amino acid residue is replaced with an amino acid residue having a similar side chain. Families of amino acid residues having similar side chains have been defined in the art. These families include: amino acids with basic side chains (e.g., lysine, arginine, histidine); acidic side chains (e.g., aspartic acid, glutamic acid); polar, negatively charged residues and their amides (e.g., aspartic acid, asparagine, glutamic, acid, glutamine; uncharged polar side chains (e.g., glycine, asparagine, glutamine, serine, threonine, tyrosine, cysteine); small aliphatic, nonpolar or slightly polar residues (e.g., Alanine, serine, threonine, proline, glycine); nonpolar side chains (e.g., alanine, valine, leucine, isoleucine, proline, phenylalanine, methionine, tryptophan); large aliphatic, nonpolar residues (e.g., methionine, leucine, isoleucine, valine, cysteine); beta-branched side chains (e.g., threonine, valine, isoleucine); aromatic side chains (e.g., tyrosine, phenylalanine, tryptophan, histidine); large aromatic side chains (e.g., tyrosine, phenylalanine, tryptophan).

Amino acid substitutions may be made in nonconserved regions that retain function. In general, such substitutions would not be made for conserved amino acid residues or for amino acid residues residing within a conserved motif, where such residues are essential for protein activity. Examples of residues that are conserved and that may be essential for protein activity include, for example, residues that are identical between all proteins contained in an alignment of similar or related toxins to the sequences of the embodiments (e.g., residues that are identical in an alignment of homologous proteins). Examples of residues that are conserved but that may allow conservative amino acid substitutions and still retain activity include, for example, residues that have only conservative substitutions between all proteins contained in an alignment of similar or related toxins to the sequences of the embodiments (e.g., residues that have only conservative substitutions between all proteins contained in the alignment homologous proteins). However, one of skill in the art would understand that functional variants may have minor conserved or nonconserved alterations in the conserved residues. Guidance as to appropriate amino acid substitutions that do not affect biological activity of the protein of interest may be found in the model of Dayhoff, et al., (1978) *Atlas of Protein Sequence and Structure* (Natl. Biomed. Res. Found., Washington, D.C.), herein incorporated by reference.

In making such changes, the hydropathic index of amino acids may be considered. The importance of the hydropathic amino acid index in conferring interactive biologic function on a protein is generally understood in the art (Kyte and Doolittle, (1982) *J Mol Biol.* 157(1):105-32). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like.

It is known in the art that certain amino acids may be substituted by other amino acids having a similar hydropathic index or score and still result in a protein with similar biological activity, i.e., still obtain a biological functionally equivalent protein. Each amino acid has been assigned a hydropathic index on the basis of its hydrophobicity and charge characteristics (Kyte and Doolittle, ibid). These are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9) and arginine (−4.5). In making such changes, the substitution of amino acids whose hydropathic indices are within +2 is preferred, those which are within +1 are particularly preferred, and those within +0.5 are even more particularly preferred.

It is also understood in the art that the substitution of like amino acids can be made effectively on the basis of hydrophilicity. U.S. Pat. No. 4,554,101, states that the greatest local average hydrophilicity of a protein, as governed by the hydrophilicity of its adjacent amino acids, correlates with a biological property of the protein.

As detailed in U.S. Pat. No. 4,554,101, the following hydrophilicity values have been assigned to amino acid residues: arginine (+3.0); lysine (+3.0); aspartate (+3.0.+0.1); glutamate (+3.0.+0.1); serine (+0.3); asparagine (+0.2); glutamine (+0.2); glycine (0); threonine (−0.4); proline (−0.5.+0.1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); tryptophan (−3.4).

Alternatively, alterations may be made to the protein sequence of many proteins at the amino or carboxy terminus without substantially affecting activity. This can include insertions, deletions or alterations introduced by modern molecular methods, such as PCR, including PCR amplifications that alter or extend the protein coding sequence by virtue of inclusion of amino acid encoding sequences in the oligonucleotides utilized in the PCR amplification. Alternatively, the protein sequences added can include entire protein-coding sequences, such as those used commonly in the art to generate protein fusions. Such fusion proteins are often used to (1) increase expression of a protein of interest (2) introduce a binding domain, enzymatic activity or epitope to facilitate either protein purification, protein detection or other experimental uses known in the art (3) target secretion or translation of a protein to a subcellular organelle, such as the periplasmic space of Gram-negative bacteria, mitochondria or chloroplasts of plants or the endoplasmic reticulum of eukaryotic cells, the latter of which often results in glycosylation of the protein.

Variant nucleotide and amino acid sequences of the disclosure also encompass sequences derived from mutagenic and recombinogenic procedures such as DNA shuffling. With such a procedure, for example, one or more different IPD079 polypeptide coding regions of the disclosure can be used to create a new IPD079 polypeptide possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, sequence motifs encoding a domain of interest may be shuffled between a pesticidal gene and other known pesticidal genes to obtain a new gene coding for a protein with an improved property of interest, such as an increased insecticidal activity. Strategies for such DNA shuffling are known in the art. See, for example, Stemmer, (1994) *Proc. Natl. Acad. Sci. USA* 91:10747-10751; Stemmer, (1994) *Nature* 370:389-391; Crameri, et al., (1997) *Nature Biotech.* 15:436-438; Moore, et al., (1997) *J. Mol. Biol.* 272:336-347; Zhang, et al., (1997) *Proc. Natl. Acad. Sci. USA* 94:4504-4509; Crameri, et al., (1998) *Nature* 391:288-291; and U.S. Pat. Nos. 5,605,793 and 5,837,458.

Domain swapping or shuffling is another mechanism for generating altered IPD079 polypeptides. Domains may be swapped between IPD079 polypeptides of the disclosure resulting in hybrid or chimeric toxins with improved insecticidal activity or target spectrum. Methods for generating recombinant proteins and testing them for pesticidal activity are well known in the art (see, for example, Naimov, et al., (2001) *Appl. Environ. Microbiol.* 67:5328-5330; de Maagd, et al., (1996) *Appl. Environ. Microbiol.* 62:1537-1543; Ge, et al., (1991) *J. Biol. Chem.* 266:17954-17958; Schnepf, et al., (1990) *J. Biol. Chem.* 265:20923-20930; Rang, et al., 91999) *Appl. Environ. Microbiol.* 65:2918-2925).

Alignment of IPD079 homologs (FIGS. 1 & 2) allows for identification of residues that are highly conserved among homologs in this family.

Compositions

Compositions comprising a plant derived perforin of the disclosure, including but limited to an IPD079 polypeptide of the disclosure, are also embraced. In some embodiments the composition comprises an IPD079 polypeptide of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, or SEQ ID NO: 140. In some embodiments the composition comprises an IPD079 fusion protein.

Antibodies

Antibodies to a plant derived perforin of the disclosure, including but limited to an IPD079 polypeptide of the embodiments or to variants or fragments thereof are also encompassed. The antibodies of the disclosure include polyclonal and monoclonal antibodies as well as fragments thereof which retain their ability to bind to IPD079 polypeptide found in the insect gut. An antibody, monoclonal antibody or fragment thereof is said to be capable of binding a molecule if it is capable of specifically reacting with the molecule to thereby bind the molecule to the antibody, monoclonal antibody or fragment thereof. The term "antibody" (Ab) or "monoclonal antibody" (Mab) is meant to include intact molecules as well as fragments or binding regions or domains thereof (such as, for example, Fab and F(ab).sub.2 fragments) which are capable of binding hapten. Such fragments are typically produced by proteolytic cleavage, such as papain or pepsin. Alternatively, hapten-binding fragments can be produced through the application of recombinant DNA technology or through synthetic chemistry. Methods for the preparation of the antibodies of the present disclosure are generally known in the art. For example, see, Antibodies, A Laboratory Manual, Ed Harlow and David Lane (eds.) Cold Spring Harbor Laboratory, N.Y. (1988), as well as the references cited therein. Standard reference works setting forth the general principles of immunology include: Klein, J. Immunology: The Science of Cell-Noncell Discrimination, John Wiley & Sons, N.Y. (1982); Dennett, et al., Monoclonal Antibodies, Hybridoma: A New Dimension in Biological Analyses, Plenum Press, N.Y. (1980) and Campbell, "Monoclonal Antibody Technology," In Laboratory Techniques in Biochemistry and Molecular Biology, Vol. 13, Burdon, et al., (eds.), Elsevier, Amsterdam (1984). See also, U.S. Pat. Nos. 4,196,265; 4,609,893; 4,713,325; 4,714,681; 4,716,111; 4,716,117 and 4,720,459. IPD079 polypeptide antibodies or antigen-binding portions thereof can be produced by a variety of techniques, including conventional monoclonal antibody methodology, for example the standard somatic cell hybridization technique of Kohler and Milstein, (1975) *Nature* 256:495. Other techniques for producing monoclonal antibody can also be employed such as viral or oncogenic transformation of B lymphocytes. An animal system for preparing hybridomas is a murine system. Immunization protocols and techniques for isolation of immunized splenocytes for fusion are known in the art. Fusion partners (e.g., murine myeloma cells) and fusion procedures are also known. The antibody and monoclonal antibodies of the disclosure can be prepared by utilizing an IPD079 polypeptide as antigens.

A kit for detecting the presence of an IPD079 polypeptide or detecting the presence of a nucleotide sequence encoding an IPD079 polypeptide in a sample is provided. In one embodiment, the kit provides antibody-based reagents for detecting the presence of an IPD079 polypeptide in a tissue sample. In another embodiment, the kit provides labeled nucleic acid probes useful for detecting the presence of one or more polynucleotides encoding IPD079 polypeptide. The kit is provided along with appropriate reagents and controls for carrying out a detection method, as well as instructions for use of the kit.

Receptor Identification and Isolation

Receptors to the IPD079 polypeptide of the embodiments or to variants or fragments thereof are also encompassed. Methods for identifying receptors are well known in the art (see, Hofmann, et. al., (1988) *Eur. J. Biochem.* 173:85-91; Gill, et al., (1995) *J. Biol. Chem.* 27277-27282) can be employed to identify and isolate the receptor that recognizes the IPD079 polypeptide using the brush-border membrane vesicles from susceptible insects. In addition to the radioactive labeling method listed in the cited literatures, IPD079 polypeptide can be labeled with fluorescent dye and other common labels such as streptavidin. Brush-border membrane vesicles (BBMV) of susceptible insects such as soybean looper and stink bugs can be prepared according to the protocols listed in the references and separated on SDS-PAGE gel and blotted on suitable membrane. Labeled IPD079 polypeptide can be incubated with blotted membrane of BBMV and labeled the IPD079 polypeptide can be identified with the labeled reporters. Identification of protein band(s) that interact with the IPD079 polypeptide can be detected by N-terminal amino acid gas phase sequencing or mass spectrometry based protein identification method (Patterson, (1998) 10.22, 1-24, Current Protocol in Molecular Biology published by John Wiley & Son Inc.). Once the protein is identified, the corresponding gene can be cloned from genomic DNA or cDNA library of the susceptible insects and binding affinity can be measured directly with the IPD079 polypeptide. Receptor function for insecticidal activity by the IPD079 polypeptide can be verified by accomplished by RNAi type of gene knock out method (Rajagopal, et al., (2002) *J. Biol. Chem.* 277:46849-46851).

Nucleotide Constructs, Expression Cassettes and Vectors

The use of the term "nucleotide constructs" herein is not intended to limit the embodiments to nucleotide constructs comprising DNA. Those of ordinary skill in the art will recognize that nucleotide constructs particularly polynucleotides and oligonucleotides composed of ribonucleotides and combinations of ribonucleotides and deoxyribonucleotides may also be employed in the methods disclosed herein. The nucleotide constructs, nucleic acids, and nucleotide sequences of the embodiments additionally encompass all complementary forms of such constructs, molecules, and sequences. Further, the nucleotide constructs, nucleotide molecules, and nucleotide sequences of the embodiments encompass all nucleotide constructs, molecules, and sequences which can be employed in the methods of the embodiments for transforming plants including, but not limited to, those comprised of deoxyribonucleotides, ribonucleotides, and combinations thereof. Such deoxyribonucleotides and ribonucleotides include both naturally occurring molecules and synthetic analogues. The nucleotide constructs, nucleic acids, and nucleotide sequences of the embodiments also encompass all forms of nucleotide constructs including, but not limited to, single-stranded forms, double-stranded forms, hairpins, stem-and-loop structures and the like.

A further embodiment relates to a transformed organism such as an organism selected from plant and insect cells, bacteria, yeast, baculovirus, protozoa, nematodes and algae. The transformed organism comprises a DNA molecule of the embodiments, an expression cassette comprising the DNA molecule or a vector comprising the expression cassette, which may be stably incorporated into the genome of the transformed organism.

The sequences of the embodiments are provided in DNA constructs for expression in the organism of interest. The construct will include 5' and 3' regulatory sequences operably linked to a sequence of the embodiments. The term "operably linked" as used herein refers to a functional linkage between a promoter and a second sequence, wherein the promoter sequence initiates and mediates transcription of the DNA sequence corresponding to the second sequence. Generally, operably linked means that the nucleic acid sequences being linked are contiguous and where necessary to join two protein coding regions in the same reading frame. The construct may additionally contain at least one additional gene to be cotransformed into the organism. Alternatively, the additional gene(s) can be provided on multiple DNA constructs.

Such a DNA construct is provided with a plurality of restriction sites for insertion of the IPD079 polypeptide gene sequence to be under the transcriptional regulation of the regulatory regions. The DNA construct may additionally contain selectable marker genes.

The DNA construct will generally include in the 5' to 3' direction of transcription: a transcriptional and translational initiation region (i.e., a promoter), a DNA sequence of the embodiments, and a transcriptional and translational termination region (i.e., termination region) functional in the organism serving as a host. The transcriptional initiation region (i.e., the promoter) may be native, analogous, foreign or heterologous to the host organism and/or to the sequence of the embodiments. Additionally, the promoter may be the natural sequence or alternatively a synthetic sequence. The term "foreign" as used herein indicates that the promoter is not found in the native organism into which the promoter is introduced. Where the promoter is "foreign" or "heterologous" to the sequence of the embodiments, it is intended that the promoter is not the native or naturally occurring promoter for the operably linked sequence of the embodiments. As used herein, a chimeric gene comprises a coding sequence operably linked to a transcription initiation region that is heterologous to the coding sequence. Where the promoter is a native or natural sequence, the expression of the operably linked sequence is altered from the wild-type expression, which results in an alteration in phenotype.

In some embodiments the DNA construct may also include a transcriptional enhancer sequence. As used herein, the term an "enhancer" refers to a DNA sequence which can stimulate promoter activity, and may be an innate element of the promoter or a heterologous element inserted to enhance the level or tissue-specificity of a promoter. Various enhancers are known in the art including for example, introns with gene expression enhancing properties in plants (US Patent Application Publication Number 2009/0144863, the ubiquitin intron (i.e., the maize ubiquitin intron 1 (see, for example, NCBI sequence S94464)), the omega enhancer or the omega prime enhancer (Gallie, et al., (1989) *Molecular Biology of RNA* ed. Cech (Liss, New York) 237-256 and Gallie, et al., (1987) *Gene* 60:217-25), the CaMV 35S enhancer (see, e.g., Benfey, et al., (1990) *EMBO J.* 9:1685-96) and the enhancers of U.S. Pat. No. 7,803,992 may also be used, each of which is incorporated by reference. The above list of transcriptional enhancers is not meant to be limiting. Any appropriate transcriptional enhancer can be used in the embodiments.

The termination region may be native with the transcriptional initiation region, may be native with the operably linked DNA sequence of interest, may be native with the plant host or may be derived from another source (i.e., foreign or heterologous to the promoter, the sequence of interest, the plant host or any combination thereof).

Convenient termination regions are available from the Ti-plasmid of *A. tumefaciens*, such as the octopine synthase and nopaline synthase termination regions. See also, Guerineau, et al., (1991) *Mol. Gen. Genet.* 262:141-144; Proudfoot, (1991) *Cell* 64:671-674; Sanfacon, et al., (1991) *Genes Dev.* 5:141-149; Mogen, et al., (1990) *Plant Cell* 2:1261-1272; Munroe, et al., (1990) *Gene* 91:151-158; Ballas, et al., (1989) *Nucleic Acids Res.* 17:7891-7903 and Joshi, et al., (1987) *Nucleic Acid Res.* 15:9627-9639.

Where appropriate, a nucleic acid may be optimized for increased expression in the host organism. Thus, where the host organism is a plant, the synthetic nucleic acids can be synthesized using plant-preferred codons for improved expression. See, for example, Campbell and Gowri, (1990) *Plant Physiol.* 92:1-11 for a discussion of host-preferred codon usage. For example, although nucleic acid sequences of the embodiments may be expressed in both monocotyledonous and dicotyledonous plant species, sequences can be modified to account for the specific codon preferences and GC content preferences of monocotyledons or dicotyledons as these preferences have been shown to differ (Murray et al. (1989) *Nucleic Acids Res.* 17:477-498). Thus, the maize-preferred codon for a particular amino acid may be derived from known gene sequences from maize. Maize codon usage for 28 genes from maize plants is listed in Table 4 of Murray, et al., supra. Methods are available in the art for synthesizing plant-preferred genes. See, for example, U.S. Pat. Nos. 5,380,831, and 5,436,391 and Murray, et al., (1989) *Nucleic Acids Res.* 17:477-498, and Liu H et al. *Mol Bio Rep* 37:677-684, 2010, herein incorporated by reference. A *Zea maize* codon usage table can be also found at kazusa.or.jp/codon/cgi-bin/showcodon.cgi?species=4577, which can be accessed using the www prefix.

A *Glycine max* codon usage table can be found at kazusa.or.jp/codon/cgi-bin/showcodon.cgi?species=3847&aa=1&style=N, which can be accessed using the www prefix.

In some embodiments the recombinant nucleic acid molecule encoding an IPD079 polypeptide has maize optimized codons.

Additional sequence modifications are known to enhance gene expression in a cellular host. These include elimination of sequences encoding spurious polyadenylation signals, exon-intron splice site signals, transposon-like repeats, and other well-characterized sequences that may be deleterious to gene expression. The GC content of the sequence may be adjusted to levels average for a given cellular host, as calculated by reference to known genes expressed in the host cell. The term "host cell" as used herein refers to a cell which contains a vector and supports the replication and/or expression of the expression vector is intended. Host cells may be prokaryotic cells such as *E. coli* or eukaryotic cells such as yeast, insect, amphibian or mammalian cells or monocotyledonous or dicotyledonous plant cells. An example of a monocotyledonous host cell is a maize host cell. When possible, the sequence is modified to avoid predicted hairpin secondary mRNA structures.

The expression cassettes may additionally contain 5' leader sequences. Such leader sequences can act to enhance translation. Translation leaders are known in the art and include: picornavirus leaders, for example, EMCV leader (Encephalomyocarditis 5' noncoding region) (Elroy-Stein, et al., (1989) *Proc. Natl. Acad. Sci. USA* 86:6126-6130); potyvirus leaders, for example, TEV leader (Tobacco Etch Virus) (Gallie, et al., (1995) *Gene* 165(2):233-238), MDMV leader (Maize Dwarf Mosaic Virus), human immunoglobulin heavy-chain binding protein (BiP) (Macejak, et al., (1991) *Nature* 353:90-94); untranslated leader from the coat protein mRNA of alfalfa mosaic virus (AMV RNA 4) (Jobling, et al, (1987) *Nature* 325:622-625); tobacco mosaic virus leader (TMV) (Gallie, et al., (1989) in *Molecular Biology of RNA*, ed. Cech (Liss, New York), pp. 237-256) and maize chlorotic mottle virus leader (MCMV) (Lommel, et al., (1991) *Virology* 81:382-385). See also, Della-Cioppa, et al., (1987) *Plant Physiol.* 84:965-968. Such constructs may also contain a "signal sequence" or "leader sequence" to facilitate co-translational or post-translational transport of the peptide to certain intracellular structures such as the chloroplast (or other plastid), endoplasmic reticulum or Golgi apparatus.

"Signal sequence" as used herein refers to a sequence that is known or suspected to result in cotranslational or post-translational peptide transport across the cell membrane. In eukaryotes, this typically involves secretion into the Golgi apparatus, with some resulting glycosylation. Insecticidal toxins of bacteria are often synthesized as protoxins, which are proteolytically activated in the gut of the target pest (Chang, (1987) *Methods Enzymol.* 153:507-516). In some embodiments, the signal sequence is located in the native sequence or may be derived from a sequence of the embodiments. "Leader sequence" as used herein refers to any sequence that when translated, results in an amino acid sequence sufficient to trigger co-translational transport of the peptide chain to a subcellular organelle. Thus, this includes leader sequences targeting transport and/or glycosylation by passage into the endoplasmic reticulum, passage to vacuoles, plastids including chloroplasts, mitochondria, and the like. Nuclear-encoded proteins targeted to the chloroplast thylakoid lumen compartment have a characteristic bipartite transit peptide, composed of a stromal targeting signal peptide and a lumen targeting signal peptide. The stromal targeting information is in the amino-proximal portion of the transit peptide. The lumen targeting signal peptide is in the carboxyl-proximal portion of the transit peptide, and contains all the information for targeting to the lumen. Recent research in proteomics of the higher plant chloroplast has achieved in the identification of numerous nuclear-encoded lumen proteins (Kieselbach et al. *FEBS LETT* 480:271-276, 2000; Peltier et al. Plant Cell 12:319-341, 2000; Bricker et al. *Biochim. Biophys Acta* 1503:350-356, 2001), the lumen targeting signal peptide of which can potentially be used in accordance with the present disclosure. About 80 proteins from *Arabidopsis*, as well as homologous proteins from spinach and garden pea, are reported by Kieselbach et al., *Photosynthesis Research,* 78:249-264, 2003. In particular, Table 2 of this publication, which is incorporated into the description herewith by reference, discloses 85 proteins from the chloroplast lumen, identified by their accession number (see also U.S. Patent Application Publication 2009/09044298). In addition, the recently published draft version of the rice genome (Goff et al, *Science* 296:92-100, 2002) is a suitable source for lumen targeting signal peptide which may be used in accordance with the present disclosure.

Suitable chloroplast transit peptides (CTP) are well known to one skilled in the art also include chimeric CTPs comprising but not limited to, an N-terminal domain, a central domain or a C-terminal domain from a CTP from *Oryza sativa* 1-deoxy-D xyulose-5-Phosphate Synthase *Oryza sativa*-Superoxide dismutase *Oryza sativa*-soluble starch synthase *Oryza sativa*-NADP-dependent Malic acid enzyme *Oryza sativa*-Phospho-2-dehydro-3-deoxyheptonate Aldolase 2 *Oryza sativa* —L—Ascorbate peroxidase 5 *Oryza sativa*-Phosphoglucan water dikinase, *Zea Mays* ssRUBISCO, *Zea Mays*-beta-glucosidase, *Zea Mays*-Malate dehydrogenase, *Zea Mays* Thioredoxin M-type U.S. Patent Application Publication 2012/0304336).

The IPD079 polypeptide gene to be targeted to the chloroplast may be optimized for expression in the chloroplast to account for differences in codon usage between the plant nucleus and this organelle. In this manner, the nucleic acids of interest may be synthesized using chloroplast-preferred codons. See, for example, U.S. Pat. No. 5,380,831, herein incorporated by reference.

In preparing the expression cassette, the various DNA fragments may be manipulated so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites or the like. For this purpose, in vitro mutagenesis, primer repair, restriction, annealing, resubstitutions, e.g., transitions and transversions, may be involved.

A number of promoters can be used in the practice of the embodiments. The promoters can be selected based on the desired outcome. The nucleic acids can be combined with constitutive, tissue-preferred, inducible or other promoters for expression in the host organism. Suitable constitutive promoters for use in a plant host cell include, for example, the core promoter of the Rsyn7 promoter and other constitutive promoters disclosed in WO 1999/43838 and U.S. Pat. No. 6,072,050; the core CaMV 35S promoter (Odell, et al., (1985) *Nature* 313:810-812); rice actin (McElroy, et al., (1990) *Plant Cell* 2:163-171); ubiquitin (Christensen, et al., (1989) *Plant Mol. Biol.* 12:619-632 and Christensen, et al., (1992) *Plant Mol. Biol.* 18:675-689); pEMU (Last, et al., (1991) *Theor. Appl. Genet.* 81:581-588); MAS (Velten, et al., (1984) *EMBO J.* 3:2723-2730); ALS promoter (U.S. Pat. No. 5,659,026) and the like. Other constitutive promoters include, for example, those discussed in U.S. Pat. Nos.

5,608,149; 5,608,144; 5,604,121; 5,569,597; 5,466,785; 5,399,680; 5,268,463; 5,608,142 and 6,177,611.

Depending on the desired outcome, it may be beneficial to express the gene from an inducible promoter. Of particular interest for regulating the expression of the nucleotide sequences of the embodiments in plants are wound-inducible promoters. Such wound-inducible promoters, may respond to damage caused by insect feeding, and include potato proteinase inhibitor (pin II) gene (Ryan, (1990) *Ann. Rev. Phytopath.* 28:425-449; Duan, et al., (1996) *Nature Biotechnology* 14:494-498); wun1 and wun2, U.S. Pat. No. 5,428,148; win1 and win2 (Stanford, et al., (1989) *Mol. Gen. Genet.* 215:200-208); systemin (McGurl, et al., (1992) *Science* 225:1570-1573); WIP1 (Rohmeier, et al., (1993) *Plant Mol. Biol.* 22:783-792; Eckelkamp, et al., (1993) *FEBS Letters* 323:73-76); MPI gene (Corderok, et al., (1994) *Plant J.* 6(2):141-150) and the like, herein incorporated by reference.

Additionally, pathogen-inducible promoters may be employed in the methods and nucleotide constructs of the embodiments. Such pathogen-inducible promoters include those from pathogenesis-related proteins (PR proteins), which are induced following infection by a pathogen; e.g., PR proteins, SAR proteins, beta-1,3-glucanase, chitinase, etc. See, for example, Redolfi, et al., (1983) *Neth. J. Plant Pathol.* 89:245-254; Uknes, et al., (1992) *Plant Cell* 4: 645-656 and Van Loon, (1985) *Plant Mol. Virol.* 4:111-116. See also, WO 1999/43819, herein incorporated by reference.

Of interest are promoters that are expressed locally at or near the site of pathogen infection. See, for example, Marineau, et al., (1987) *Plant Mol. Biol.* 9:335-342; Matton, et al., (1989) *Molecular Plant-Microbe Interactions* 2:325-331; Somsisch, et al., (1986) *Proc. Natl. Acad. Sci. USA* 83:2427-2430; Somsisch, et al., (1988) *Mol. Gen. Genet.* 2:93-98 and Yang, (1996) *Proc. Natl. Acad. Sci. USA* 93:14972-14977. See also, Chen, et al., (1996) *Plant J.* 10:955-966; Zhang, et al., (1994) *Proc. Natl. Acad. Sci. USA* 91:2507-2511; Warner, et al., (1993) *Plant J.* 3:191-201; Siebertz, et al., (1989) *Plant Cell* 1:961-968; U.S. Pat. No. 5,750,386 (nematode-inducible) and the references cited therein. Of particular interest is the inducible promoter for the maize PRms gene, whose expression is induced by the pathogen *Fusarium moniliforme* (see, for example, Cordero, et al., (1992) *Physiol. Mol. Plant Path.* 41:189-200).

Chemical-regulated promoters can be used to modulate the expression of a gene in a plant through the application of an exogenous chemical regulator. Depending upon the objective, the promoter may be a chemical-inducible promoter, where application of the chemical induces gene expression or a chemical-repressible promoter, where application of the chemical represses gene expression. Chemical-inducible promoters are known in the art and include, but are not limited to, the maize In2-2 promoter, which is activated by benzenesulfonamide herbicide safeners, the maize GST promoter, which is activated by hydrophobic electrophilic compounds that are used as pre-emergent herbicides, and the tobacco PR-1a promoter, which is activated by salicylic acid. Other chemical-regulated promoters of interest include steroid-responsive promoters (see, for example, the glucocorticoid-inducible promoter in Schena, et al., (1991) *Proc. Natl. Acad. Sci. USA* 88:10421-10425 and McNellis, et al., (1998) *Plant J.* 14(2):247-257) and tetracycline-inducible and tetracycline-repressible promoters (see, for example, Gatz, et al., (1991) *Mol. Gen. Genet.* 227:229-237 and U.S. Pat. Nos. 5,814,618 and 5,789,156), herein incorporated by reference.

Tissue-preferred promoters can be utilized to target enhanced IPD079 polypeptide expression within a particular plant tissue. Tissue-preferred promoters include those discussed in Yamamoto, et al., (1997) *Plant J.* 12(2)255-265; Kawamata, et al., (1997) *Plant Cell Physiol.* 38(7):792-803; Hansen, et al., (1997) *Mol. Gen Genet.* 254(3):337-343; Russell, et al., (1997) *Transgenic Res.* 6(2):157-168; Rinehart, et al., (1996) *Plant Physiol.* 112(3):1331-1341; Van Camp, et al., (1996) *Plant Physiol.* 112(2):525-535; Canevascini, et al., (1996) *Plant Physiol.* 112(2):513-524; Yamamoto, et al., (1994) *Plant Cell Physiol.* 35(5):773-778; Lam, (1994) *Results Probl. Cell Differ.* 20:181-196; Orozco, et al, (1993) *Plant Mol Biol.* 23(6):1129-1138; Matsuoka, et al., (1993) *Proc Natl. Acad. Sci. USA* 90(20):9586-9590 and Guevara-Garcia, et al., (1993) *Plant J.* 4(3):495-505. Such promoters can be modified, if necessary, for weak expression.

Leaf-preferred promoters are known in the art. See, for example, Yamamoto, et al., (1997) *Plant J.* 12(2):255-265; Kwon, et al., (1994) *Plant Physiol.* 105:357-67; Yamamoto, et al., (1994) *Plant Cell Physiol.* 35(5):773-778; Gotor, et al., (1993) *Plant J.* 3:509-18; Orozco, et al., (1993) *Plant Mol. Biol.* 23(6):1129-1138 and Matsuoka, et al., (1993) *Proc. Natl. Acad. Sci. USA* 90(20):9586-9590.

Root-preferred or root-specific promoters are known and can be selected from the many available from the literature or isolated de novo from various compatible species. See, for example, Hire, et al., (1992) *Plant Mol. Biol.* 20(2):207-218 (soybean root-specific glutamine synthetase gene); Keller and Baumgartner, (1991) *Plant Cell* 3(10):1051-1061 (root-specific control element in the GRP 1.8 gene of French bean); Sanger, et al., (1990) *Plant Mol. Biol.* 14(3):433-443 (root-specific promoter of the mannopine synthase (MAS) gene of *Agrobacterium tumefaciens*) and Miao, et al., (1991) *Plant Cell* 3(1):11-22 (full-length cDNA clone encoding cytosolic glutamine synthetase (GS), which is expressed in roots and root nodules of soybean). See also, Bogusz, et al., (1990) *Plant Cell* 2(7):633-641, where two root-specific promoters isolated from hemoglobin genes from the nitrogen-fixing nonlegume *Parasponia andersonii* and the related non-nitrogen-fixing nonlegume *Trema tomentosa* are described. The promoters of these genes were linked to a β-glucuronidase reporter gene and introduced into both the nonlegume *Nicotiana tabacum* and the legume *Lotus corniculatus*, and in both instances root-specific promoter activity was preserved. Leach and Aoyagi, (1991) describe their analysis of the promoters of the highly expressed rolC and rolD root-inducing genes of *Agrobacterium rhizogenes* (see, *Plant Science* (Limerick) 79(1):69-76). They concluded that enhancer and tissue-preferred DNA determinants are dissociated in those promoters. Teeri, et al., (1989) used gene fusion to lacZ to show that the *Agrobacterium* T-DNA gene encoding octopine synthase is especially active in the epidermis of the root tip and that the TR2' gene is root specific in the intact plant and stimulated by wounding in leaf tissue, an especially desirable combination of characteristics for use with an insecticidal or larvacidal gene (see, *EMBO J.* 8(2):343-350). The TR1' gene fused to nptII (neomycin phosphotransferase II) showed similar characteristics. Additional root-preferred promoters include the VfENOD-GRP3 gene promoter (Kuster, et al., (1995) *Plant Mol. Biol.* 29(4):759-772) and rolB promoter (Capana, et al., (1994) *Plant Mol. Biol.* 25(4):681-691. See also, U.S. Pat. Nos. 5,837,876; 5,750,386; 5,633,363; 5,459,252; 5,401,836; 5,110,732 and 5,023,179. *Arabidopsis thaliana* root-preferred regulatory sequences are disclosed in US20130117883.

"Seed-preferred" promoters include both "seed-specific" promoters (those promoters active during seed development such as promoters of seed storage proteins) as well as "seed-germinating" promoters (those promoters active during seed germination). See, Thompson, et al., (1989) *BioEssays* 10:108, herein incorporated by reference. Such seed-preferred promoters include, but are not limited to, Cim1 (cytokine-induced message); cZ19B1 (maize 19 kDa zein); and milps (myo-inositol-1-phosphate synthase) (see, U.S. Pat. No. 6,225,529, herein incorporated by reference). Gamma-zein and Glb-1 are endosperm-specific promoters. For dicots, seed-specific promoters include, but are not limited to, Kunitz trypsin inhibitor 3 (KTi3) (Jofuku and Goldberg, (1989) *Plant Cell* 1:1079-1093), bean β-phaseolin, napin, β-conglycinin, glycinin 1, soybean lectin, cruciferin, and the like. For monocots, seed-specific promoters include, but are not limited to, maize 15 kDa zein, 22 kDa zein, 27 kDa zein, g-zein, waxy, shrunken 1, shrunken 2, globulin 1, etc. See also, WO 2000/12733, where seed-preferred promoters from end1 and end2 genes are disclosed; herein incorporated by reference. In dicots, seed specific promoters include but are not limited to seed coat promoter from *Arabidopsis*, pBAN; and the early seed promoters from *Arabidopsis*, p26, p63, and p63tr (U.S. Pat. Nos. 7,294,760 and 7,847,153). A promoter that has "preferred" expression in a particular tissue is expressed in that tissue to a greater degree than in at least one other plant tissue. Some tissue-preferred promoters show expression almost exclusively in the particular tissue.

Where low level expression is desired, weak promoters will be used. Generally, the term "weak promoter" as used herein refers to a promoter that drives expression of a coding sequence at a low level. By low level expression at levels of between about 1/1,000 transcripts to about 1/100,000 transcripts to about 1/500,000 transcripts is intended. Alternatively, it is recognized that the term "weak promoters" also encompasses promoters that drive expression in only a few cells and not in others to give a total low level of expression. Where a promoter drives expression at unacceptably high levels, portions of the promoter sequence can be deleted or modified to decrease expression levels.

Such weak constitutive promoters include, for example the core promoter of the Rsyn7 promoter (WO 1999/43838 and U.S. Pat. No. 6,072,050), the core 35S CaMV promoter, and the like. Other constitutive promoters include, for example, those disclosed in U.S. Pat. Nos. 5,608,149; 5,608,144; 5,604,121; 5,569,597; 5,466,785; 5,399,680; 5,268,463; 5,608,142 and 6,177,611, herein incorporated by reference.

The above list of promoters is not meant to be limiting. Any appropriate promoter can be used in the embodiments.

Generally, the expression cassette will comprise a selectable marker gene for the selection of transformed cells. Selectable marker genes are utilized for the selection of transformed cells or tissues. Marker genes include genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones and 2,4-dichlorophenoxyacetate (2,4-D). Additional examples of suitable selectable marker genes include, but are not limited to, genes encoding resistance to chloramphenicol (Herrera Estrella, et al., (1983) *EMBO J.* 2:987-992); methotrexate (Herrera Estrella, et al., (1983) *Nature* 303:209-213 and Meijer, et al., (1991) *Plant Mol. Biol.* 16:807-820); streptomycin (Jones, et al., (1987) *Mol. Gen. Genet.* 210:86-91); spectinomycin (Bretagne-Sagnard, et al., (1996) *Transgenic Res.* 5:131-137); bleomycin (Hille, et al., (1990) *Plant Mol. Biol.* 7:171-176); sulfonamide (Guerineau, et al., (1990) *Plant Mol. Biol.* 15:127-136); bromoxynil (Stalker, et al., (1988) *Science* 242:419-423); glyphosate (Shaw, et al., (1986) *Science* 233:478-481 and U.S. patent application Ser. Nos. 10/004,357 and 10/427,692); phosphinothricin (DeBlock, et al., (1987) *EMBO J.* 6:2513-2518). See generally, Yarranton, (1992) *Curr. Opin. Biotech.* 3:506-511; Christopherson, et al., (1992) *Proc. Natl. Acad. Sci. USA* 89:6314-6318; Yao, et al., (1992) *Cell* 71:63-72; Reznikoff, (1992) *Mol. Microbiol.* 6:2419-2422; Barkley, et al., (1980) in *The Operon*, pp. 177-220; Hu, et al., (1987) *Cell* 48:555-566; Brown, et al., (1987) *Cell* 49:603-612; Figge, et al., (1988) *Cell* 52:713-722; Deuschle, et al., (1989) *Proc. Natl. Acad. Sci. USA* 86:5400-5404; Fuerst, et al., (1989) *Proc. Natl. Acad. Sci. USA* 86:2549-2553; Deuschle, et al., (1990) *Science* 248:480-483; Gossen, (1993) Ph.D. Thesis, University of Heidelberg; Reines, et al., (1993) *Proc. Natl. Acad. Sci. USA* 90:1917-1921; Labow, et al., (1990) *Mol. Cell. Biol.* 10:3343-3356; Zambretti, et al., (1992) *Proc. Natl. Acad. Sci. USA* 89:3952-3956; Bairn, et al., (1991) *Proc. Natl. Acad. Sci. USA* 88:5072-5076; Wyborski, et al., (1991) *Nucleic Acids Res.* 19:4647-4653; Hillenand-Wissman, (1989) *Topics Mol. Struc. Biol.* 10:143-162; Degenkolb, et al., (1991) *Antimicrob. Agents Chemother.* 35:1591-1595; Kleinschnidt, et al., (1988) *Biochemistry* 27:1094-1104; Bonin, (1993) Ph.D. Thesis, University of Heidelberg; Gossen, et al., (1992) *Proc. Natl. Acad. Sci. USA* 89:5547-5551; Oliva, et al., (1992) *Antimicrob. Agents Chemother.* 36:913-919; Hlavka, et al., (1985) *Handbook of Experimental Pharmacology*, Vol. 78 (Springer-Verlag, Berlin) and Gill, et al., (1988) *Nature* 334:721-724. Such disclosures are herein incorporated by reference.

The above list of selectable marker genes is not meant to be limiting. Any selectable marker gene can be used in the embodiments.

Plant Transformation

The methods of the embodiments involve introducing a polypeptide or polynucleotide into a plant. "Introducing" is as used herein means presenting to the plant the polynucleotide or polypeptide in such a manner that the sequence gains access to the interior of a cell of the plant. The methods of the embodiments do not depend on a particular method for introducing a polynucleotide or polypeptide into a plant, only that the polynucleotide or polypeptides gains access to the interior of at least one cell of the plant. Methods for introducing polynucleotide or polypeptides into plants are known in the art including, but not limited to, stable transformation methods, transient transformation methods, and virus-mediated methods.

"Stable transformation" is as used herein means that the nucleotide construct introduced into a plant integrates into the genome of the plant and is capable of being inherited by the progeny thereof. "Transient transformation" as used herein means that a polynucleotide is introduced into the plant and does not integrate into the genome of the plant or a polypeptide is introduced into a plant. "Plant" as used herein refers to whole plants, plant organs (e.g., leaves, stems, roots, etc.), seeds, plant cells, propagules, embryos and progeny of the same. Plant cells can be differentiated or undifferentiated (e.g. callus, suspension culture cells, protoplasts, leaf cells, root cells, phloem cells and pollen).

Transformation protocols as well as protocols for introducing nucleotide sequences into plants may vary depending on the type of plant or plant cell, i.e., monocot or dicot, targeted for transformation. Suitable methods of introducing nucleotide sequences into plant cells and subsequent insertion into the plant genome include microinjection (Crossway, et al., (1986) *Biotechniques* 4:320-334), electroporation (Riggs, et al., (1986) *Proc. Natl. Acad. Sci. USA* 83:5602-5606), *Agrobacterium*-mediated transformation (U.S. Pat. Nos. 5,563,055 and 5,981,840), direct gene transfer (Paszkowski, et al., (1984) *EMBO J.* 3:2717-2722) and ballistic particle acceleration (see, for example, U.S. Pat. Nos. 4,945,050; 5,879,918; 5,886,244 and 5,932,782; Tomes, et al., (1995) in *Plant Cell, Tissue, and Organ Culture: Fundamental Methods*, ed. Gamborg and Phillips, (Springer-Verlag, Berlin) and McCabe, et al., (1988) *Biotechnology* 6:923-926) and LecI transformation (WO 00/28058). For potato transformation see, Tu, et al., (1998) *Plant Molecular Biology* 37:829-838 and Chong, et al., (2000) *Transgenic Research* 9:71-78. Additional transformation procedures can be found in Weissinger, et al., (1988) *Ann. Rev. Genet.* 22:421-477; Sanford, et al., (1987) *Particulate Science and Technology* 5:27-37 (onion); Christou, et al., (1988) *Plant Physiol.* 87:671-674 (soybean); McCabe, et al., (1988) *Bio/Technology* 6:923-926 (soybean); Finer and McMullen, (1991) *In Vitro Cell Dev. Biol.* 27P:175-182 (soybean); Singh, et al., (1998) *Theor. Appl. Genet.* 96:319-324 (soybean); Datta, et al., (1990) *Biotechnology* 8:736-740 (rice); Klein, et al., (1988) *Proc. Natl. Acad. Sci. USA* 85:4305-4309 (maize); Klein, et al, (1988) *Biotechnology* 6:559-563 (maize); U.S. Pat. Nos. 5,240,855; 5,322,783 and 5,324,646; Klein, et al., (1988) *Plant Physiol.* 91:440-444 (maize); Fromm, et al., (1990) *Biotechnology* 8:833-839 (maize); Hooykaas-Van Slogteren, et al., (1984) *Nature (London)* 311:763-764; U.S. Pat. No. 5,736,369 (cereals); Bytebier, et al., (1987) *Proc. Natl. Acad. Sci. USA* 84:5345-5349 (Liliaceae); De Wet, et al., (1985) in *The Experimental Manipulation of Ovule Tissues*, ed. Chapman, et al., (Longman, N.Y.), pp. 197-209 (pollen); Kaeppler, et al., (1990) *Plant Cell Reports* 9:415-418 and Kaeppler, et al., (1992) *Theor. Appl. Genet.* 84:560-566 (whisker-mediated transformation); D'Halluin, et al., (1992) *Plant Cell* 4:1495-1505 (electroporation); Li, et al., (1993) *Plant Cell Reports* 12:250-255 and Christou and Ford, (1995) *Annals of Botany* 75:407-413 (rice); Osjoda, et al., (1996) *Nature Biotechnology* 14:745-750 (maize via *Agrobacterium tumefaciens*); all of which are herein incorporated by reference.

In specific embodiments, the sequences of the embodiments can be provided to a plant using a variety of transient transformation methods. Such transient transformation methods include, but are not limited to, the introduction of the IPD079 polynucleotide or variants and fragments thereof directly into the plant or the introduction of the IPD079 polypeptide transcript into the plant. Such methods include, for example, microinjection or particle bombardment. See, for example, Crossway, et al., (1986) *Mol Gen. Genet.* 202:179-185; Nomura, et al., (1986) *Plant Sci.* 44:53-58; Hepler, et al., (1994) *Proc. Natl. Acad. Sci.* 91:2176-2180 and Hush, et al., (1994) *The Journal of Cell Science* 107: 775-784, all of which are herein incorporated by reference. Alternatively, the IPD079 polynucleotide can be transiently transformed into the plant using techniques known in the art. Such techniques include viral vector system and the precipitation of the polynucleotide in a manner that precludes subsequent release of the DNA. Thus, transcription from the particle-bound DNA can occur, but the frequency with which it is released to become integrated into the genome is greatly reduced. Such methods include the use of particles coated with polyethylamine (PEI; Sigma #P3143).

Methods are known in the art for the targeted insertion of a polynucleotide at a specific location in the plant genome. In one embodiment, the insertion of the polynucleotide at a desired genomic location is achieved using a site-specific recombination system. See, for example, WO 1999/25821, WO 1999/25854, WO 1999/25840, WO 1999/25855 and WO 1999/25853, all of which are herein incorporated by reference. Briefly, the polynucleotide of the embodiments can be contained in transfer cassette flanked by two non-identical recombination sites. The transfer cassette is introduced into a plant have stably incorporated into its genome a target site which is flanked by two non-identical recombination sites that correspond to the sites of the transfer cassette. An appropriate recombinase is provided and the transfer cassette is integrated at the target site. The polynucleotide of interest is thereby integrated at a specific chromosomal position in the plant genome.

Plant transformation vectors may be comprised of one or more DNA vectors needed for achieving plant transformation. For example, it is a common practice in the art to utilize plant transformation vectors that are comprised of more than one contiguous DNA segment. These vectors are often referred to in the art as "binary vectors". Binary vectors as well as vectors with helper plasmids are most often used for *Agrobacterium*-mediated transformation, where the size and complexity of DNA segments needed to achieve efficient transformation is quite large, and it is advantageous to separate functions onto separate DNA molecules. Binary vectors typically contain a plasmid vector that contains the cis-acting sequences required for T-DNA transfer (such as left border and right border), a selectable marker that is engineered to be capable of expression in a plant cell, and a "gene of interest" (a gene engineered to be capable of expression in a plant cell for which generation of transgenic plants is desired). Also present on this plasmid vector are sequences required for bacterial replication. The cis-acting sequences are arranged in a fashion to allow efficient transfer into plant cells and expression therein. For example, the selectable marker gene and the pesticidal gene are located between the left and right borders. Often a second plasmid vector contains the trans-acting factors that mediate T-DNA transfer from *Agrobacterium* to plant cells. This plasmid often contains the virulence functions (Vir genes) that allow infection of plant cells by *Agrobacterium*, and transfer of DNA by cleavage at border sequences and vir-mediated DNA transfer, as is understood in the art (Hellens and Mullineaux, (2000) *Trends in Plant Science* 5:446-451). Several types of *Agrobacterium* strains (e.g. LBA4404, GV3101, EHA101, EHA105, etc.) can be used for plant transformation. The second plasmid vector is not necessary for transforming the plants by other methods such as microprojection, microinjection, electroporation, polyethylene glycol, etc.

In general, plant transformation methods involve transferring heterologous DNA into target plant cells (e.g., immature or mature embryos, suspension cultures, undifferentiated callus, protoplasts, etc.), followed by applying a maximum threshold level of appropriate selection (depending on the selectable marker gene) to recover the transformed plant cells from a group of untransformed cell mass. Following integration of heterologous foreign DNA into plant cells, one then applies a maximum threshold level of appropriate selection in the medium to kill the untransformed cells to separate and proliferate the putatively transformed cells that survive from this selection treatment by transferring regularly to a fresh medium. By continuous passage and challenge with appropriate selection, one identifies and proliferates the cells that are transformed with the plasmid vector. Molecular and biochemical methods can then be used to confirm the presence of the integrated heterologous gene of interest into the genome of the transgenic plant.

Explants are typically transferred to a fresh supply of the same medium and cultured routinely. Subsequently, the transformed cells are differentiated into shoots after placing on regeneration medium supplemented with a maximum threshold level of selecting agent. The shoots are then transferred to a selective rooting medium for recovering rooted shoot or plantlet. The transgenic plantlet then grows into a mature plant and produces fertile seeds (e.g., Hiei, et al., (1994) *The Plant Journal* 6:271-282; Ishida, et al., (1996) *Nature Biotechnology* 14:745-750). Explants are typically transferred to a fresh supply of the same medium and cultured routinely. A general description of the techniques and methods for generating transgenic plants are found in Ayres and Park, (1994) *Critical Reviews in Plant Science* 13:219-239 and Bommineni and Jauhar, (1997) *Maydica* 42:107-120. Since the transformed material contains many cells; both transformed and non-transformed cells are present in any piece of subjected target callus or tissue or group of cells. The ability to kill non-transformed cells and allow transformed cells to proliferate results in transformed plant cultures. Often, the ability to remove non-transformed cells is a limitation to rapid recovery of transformed plant cells and successful generation of transgenic plants.

The cells that have been transformed may be grown into plants in accordance with conventional ways. See, for example, McCormick, et al., (1986) *Plant Cell Reports* 5:81-84. These plants may then be grown, and either pollinated with the same transformed strain or different strains, and the resulting hybrid having constitutive or inducible expression of the desired phenotypic characteristic identified. Two or more generations may be grown to ensure that expression of the desired phenotypic characteristic is stably maintained and inherited and then seeds harvested to ensure that expression of the desired phenotypic characteristic has been achieved.

The nucleotide sequences of the embodiments may be provided to the plant by contacting the plant with a virus or viral nucleic acids. Generally, such methods involve incorporating the nucleotide construct of interest within a viral DNA or RNA molecule. It is recognized that the recombinant proteins of the embodiments may be initially synthesized as part of a viral polyprotein, which later may be processed by proteolysis in vivo or in vitro to produce the desired IPD079 polypeptide. It is also recognized that such a viral polyprotein, comprising at least a portion of the amino acid sequence of an IPD079 of the embodiments, may have the desired pesticidal activity. Such viral polyproteins and the nucleotide sequences that encode for them are encompassed by the embodiments. Methods for providing plants with nucleotide constructs and producing the encoded proteins in the plants, which involve viral DNA or RNA molecules, are known in the art. See, for example, U.S. Pat. Nos. 5,889,191; 5,889,190; 5,866,785; 5,589,367 and 5,316,931; herein incorporated by reference.

Methods for transformation of chloroplasts are known in the art. See, for example, Svab, et al., (1990) *Proc. Natl. Acad. Sci. USA* 87:8526-8530; Svab and Maliga, (1993) *Proc. Natl. Acad. Sci. USA* 90:913-917; Svab and Maliga, (1993) *EMBO J.* 12:601-606. The method relies on particle gun delivery of DNA containing a selectable marker and targeting of the DNA to the plastid genome through homologous recombination. Additionally, plastid transformation can be accomplished by transactivation of a silent plastid-borne transgene by tissue-preferred expression of a nuclear-encoded and plastid-directed RNA polymerase. Such a system has been reported in McBride, et al., (1994) *Proc. Natl. Acad. Sci. USA* 91:7301-7305.

The embodiments further relate to plant-propagating material of a transformed plant of the embodiments including, but not limited to, seeds, tubers, corms, bulbs, leaves and cuttings of roots and shoots.

The embodiments may be used for transformation of any plant species, including, but not limited to, monocots and dicots. Examples of plants of interest include, but are not limited to, corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), *papaya* (*Carica papaya*), cashew (*Anacardium occidentale*), macadamia (Macadamia *integrifolia*), almond (*Prunus amygdalus*), sugar beets (*Beta vulgaris*), sugarcane (*Saccharum* spp.), oats, barley, vegetables ornamentals, and conifers.

Vegetables include tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals include azalea (*Rhododendron* spp.), *hydrangea* (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum. Conifers that may be employed in practicing the embodiments include, for example, pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*); Douglas-fir (*Pseudotsuga menziesii*); Western hemlock (*Tsuga canadensis*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*). Plants of the embodiments include crop plants (for example, corn, alfalfa, sunflower, *Brassica*, soybean, cotton, safflower, peanut, sorghum, wheat, millet, tobacco, etc.), such as corn and soybean plants.

Turf grasses include, but are not limited to: annual bluegrass (*Poa annua*); annual ryegrass (*Lolium multiflorum*); Canada bluegrass (*Poa compressa*); Chewing's fescue (*Festuca rubra*); colonial bentgrass (*Agrostis tenuis*); creeping bentgrass (*Agrostis palustris*); crested wheatgrass (*Agropyron desertorum*); fairway wheatgrass (*Agropyron cristatum*); hard fescue (*Festuca longifolia*); Kentucky bluegrass (*Poa pratensis*); orchardgrass (Dactyls *glomerata*); perennial ryegrass (*Lolium perenne*); red fescue (*Festuca rubra*);

redtop (*Agrostis alba*); rough bluegrass (*Poa trivialis*); sheep fescue (*Festuca ovine*); smooth bromegrass (*Bromus inermis*); tall fescue (*Festuca arundinacea*); timothy (*Phleum pratense*); velvet bentgrass (*Agrostis canina*); weeping alkaligrass (*Puccinellia distans*); western wheatgrass (*Agropyron smithii*); Bermuda grass (*Cynodon* spp.); St. Augustine grass (*Stenotaphrum secundatum*); zoysia grass (*Zoysia* spp.); Bahia grass (*Paspalum notatum*); carpet grass (*Axonopus affinis*); centipede grass (*Eremochloa ophiuroides*); kikuyu grass (*Pennisetum clandesinum*); seashore paspalum (*Paspalum vaginatum*); blue gramma (*Bouteloua gracilis*); buffalo grass (*Buchloe dactyloids*); sideoats gramma (*Bouteloua curtipendula*).

Plants of interest include grain plants that provide seeds of interest, oil-seed plants, and leguminous plants. Seeds of interest include grain seeds, such as corn, wheat, barley, rice, sorghum, rye, millet, etc. Oil-seed plants include cotton, soybean, safflower, sunflower, *Brassica*, maize, alfalfa, palm, coconut, flax, castor, olive, etc. Leguminous plants include beans and peas. Beans include guar, locust bean, fenugreek, soybean, garden beans, cowpea, mung bean, lima bean, fava bean, lentils, chickpea, etc.

Evaluation of Plant Transformation

Following introduction of heterologous foreign DNA into plant cells, the transformation or integration of heterologous gene in the plant genome is confirmed by various methods such as analysis of nucleic acids, proteins and metabolites associated with the integrated gene.

PCR analysis is a rapid method to screen transformed cells, tissue or shoots for the presence of incorporated gene at the earlier stage before transplanting into the soil (Sambrook and Russell, (2001) Molecular Cloning: A Laboratory Manual. Cold Spring Harbor Laboratory Press, Cold Spring Harbor, N.Y.). PCR is carried out using oligonucleotide primers specific to the gene of interest or *Agrobacterium* vector background, etc.

Plant transformation may be confirmed by Southern blot analysis of genomic DNA (Sambrook and Russell, (2001) supra). In general, total DNA is extracted from the transformant, digested with appropriate restriction enzymes, fractionated in an agarose gel and transferred to a nitrocellulose or nylon membrane. The membrane or "blot" is then probed with, for example, radiolabeled 32P target DNA fragment to confirm the integration of introduced gene into the plant genome according to standard techniques (Sambrook and Russell, (2001) supra).

In Northern blot analysis, RNA is isolated from specific tissues of transformant, fractionated in a formaldehyde agarose gel, and blotted onto a nylon filter according to standard procedures that are routinely used in the art (Sambrook and Russell, (2001) supra). Expression of RNA encoded by the pesticidal gene is then tested by hybridizing the filter to a radioactive probe derived from a pesticidal gene, by methods known in the art (Sambrook and Russell, (2001) supra).

Western blot, biochemical assays and the like may be carried out on the transgenic plants to confirm the presence of protein encoded by the pesticidal gene by standard procedures (Sambrook and Russell, 2001, supra) using antibodies that bind to one or more epitopes present on the IPD079 polypeptide.

Stacking of Traits in Transgenic Plant

Transgenic plants may comprise a stack of one or more insecticidal polynucleotides disclosed herein with one or more additional polynucleotides resulting in the production or suppression of multiple polypeptide sequences. Transgenic plants comprising stacks of polynucleotide sequences can be obtained by either or both of traditional breeding methods or through genetic engineering methods. These methods include, but are not limited to, breeding individual lines each comprising a polynucleotide of interest, transforming a transgenic plant comprising a gene disclosed herein with a subsequent gene and co-transformation of genes into a single plant cell. As used herein, the term "stacked" includes having the multiple traits present in the same plant (i.e., both traits are incorporated into the nuclear genome, one trait is incorporated into the nuclear genome and one trait is incorporated into the genome of a plastid or both traits are incorporated into the genome of a plastid). In one non-limiting example, "stacked traits" comprise a molecular stack where the sequences are physically adjacent to each other. A trait, as used herein, refers to the phenotype derived from a particular sequence or groups of sequences. Co-transformation of genes can be carried out using single transformation vectors comprising multiple genes or genes carried separately on multiple vectors. If the sequences are stacked by genetically transforming the plants, the polynucleotide sequences of interest can be combined at any time and in any order. The traits can be introduced simultaneously in a co-transformation protocol with the polynucleotides of interest provided by any combination of transformation cassettes. For example, if two sequences will be introduced, the two sequences can be contained in separate transformation cassettes (trans) or contained on the same transformation cassette (cis). Expression of the sequences can be driven by the same promoter or by different promoters. In certain cases, it may be desirable to introduce a transformation cassette that will suppress the expression of the polynucleotide of interest. This may be combined with any combination of other suppression cassettes or overexpression cassettes to generate the desired combination of traits in the plant. It is further recognized that polynucleotide sequences can be stacked at a desired genomic location using a site-specific recombination system. See, for example, WO 1999/25821, WO 1999/25854, WO 1999/25840, WO 1999/25855 and WO 1999/25853, all of which are herein incorporated by reference.

In some embodiments the polynucleotides encoding the IPD079 polypeptide disclosed herein, alone or stacked with one or more additional insect resistance traits can be stacked with one or more additional input traits (e.g., herbicide resistance, fungal resistance, virus resistance, stress tolerance, disease resistance, male sterility, stalk strength, and the like) or output traits (e.g., increased yield, modified starches, improved oil profile, balanced amino acids, high lysine or methionine, increased digestibility, improved fiber quality, drought resistance, and the like). Thus, the polynucleotide embodiments can be used to provide a complete agronomic package of improved crop quality with the ability to flexibly and cost effectively control any number of agronomic pests.

Transgenes useful for stacking include but are not limited to:

1. Transgenes that Confer Resistance to Insects or Disease and that Encode:

(A) Plant disease resistance genes. Plant defenses are often activated by specific interaction between the product of a disease resistance gene (R) in the plant and the product of a corresponding avirulence (Avr) gene in the pathogen. A plant variety can be transformed with cloned resistance gene to engineer plants that are resistant to specific pathogen strains. See, for example, Jones, et al., (1994) *Science* 266:789 (cloning of the tomato Cf-9 gene for resistance to *Cladosporium fulvum*); Martin, et al., (1993) *Science* 262:1432 (tomato Pto gene for resistance to *Pseudomonas syringae* pv. tomato encodes a protein kinase); Mindrinos, et al., (1994) *Cell* 78:1089 (*Arabidopsis* RSP2 gene for resistance to *Pseudomonas syringae*), McDowell and Woffenden, (2003) *Trends Biotechnol.* 21(4):178-83 and Toyoda, et al., (2002) *Transgenic Res.* 11(6):567-82. A plant resistant to a disease is one that is more resistant to a pathogen as compared to the wild type plant.

(B) Genes encoding a *Bacillus thuringiensis* protein, a derivative thereof or a synthetic polypeptide modeled thereon. See, for example, Geiser, et al., (1986) *Gene* 48:109, who disclose the cloning and nucleotide sequence of a Bt delta-endotoxin gene. Moreover, DNA molecules encoding delta-endotoxin genes can be purchased from American Type Culture Collection (Rockville, Md.), for example, under ATCC® Accession Numbers 40098, 67136, 31995 and 31998. Other non-limiting examples of *Bacillus thuringiensis* transgenes being genetically engineered are given in the following patents and patent applications and hereby are incorporated by reference for this purpose: U.S. Pat. Nos. 5,188,960; 5,689,052; 5,880,275; 5,986,177; 6,023,013, 6,060,594, 6,063,597, 6,077,824, 6,620,988, 6,642,030, 6,713,259, 6,893,826, 7,105,332; 7,179,965, 7,208,474; 7,227,056, 7,288,643, 7,323,556, 7,329,736, 7,449,552, 7,468,278, 7,510,878, 7,521,235, 7,544,862, 7,605,304, 7,696,412, 7,629,504, 7,705,216, 7,772,465, 7,790,846, 7,858,849 and WO 1991/14778; WO 1999/31248; WO 2001/12731; WO 1999/24581 and WO 1997/40162.

Genes encoding pesticidal proteins may also be stacked including but are not limited to: insecticidal proteins from *Pseudomonas* sp. such as PSEEN3174 (Monalysin; (2011) *PLoS Pathogens* 7:1-13); from *Pseudomonas protegens* strain CHA0 and Pf-5 (previously *fluorescens*) (Pechy-Tarr, (2008) *Environmental Microbiology* 10:2368-2386; GenBank Accession No. EU400157); from *Pseudomonas Taiwanensis* (Liu, et al., (2010) *J. Agric. Food Chem.*, 58:12343-12349) and from *Pseudomonas pseudoalcligenes* (Zhang, et al., (2009) *Annals of Microbiology* 59:45-50 and Li, et al., (2007) *Plant Cell Tiss. Organ Cult.* 89:159-168); insecticidal proteins from *Photorhabdus* sp. and *Xenorhabdus* sp. (Hinchliffe, et al., (2010) *The Open Toxicology Journal*, 3:101-118 and Morgan, et al., (2001) *Applied and Envir. Micro.* 67:2062-2069); U.S. Pat. Nos. 6,048,838, and 6,379,946; a PIP-1 polypeptide of U.S. Patent Publication US20140007292; an AfIP-1A and/or AfIP-1B polypeptide of U.S. Patent Publication US20140033361; a PHI-4 polypeptide of U.S. Patent Publication US20140274885 and US20160040184; a PIP-47 polypeptide of PCT Publication Number WO2015/023,846, a PIP-72 polypeptide of PCT Publication Number WO2015/038,734; a PtIP-50 polypeptide and a PtIP-65 polypeptide of PCT Publication Number WO2015/120,270; a PtIP-83 polypeptide of PCT Publication Number WO2015/120,276; a PtIP-96 polypeptide of PCT Serial Number PCT/US15/55502; an IPD073 polypeptide of PCT Serial Number PCT/US16/32273, an IPD082 polypeptide of U.S. Ser. No. 62/269,482, and δ-endotoxins including, but not limited to, the Cry1, Cry2, Cry3, Cry4, Cry5, Cry6, Cry7, Cry8, Cry9, Cry10, Cry11, Cry12, Cry13, Cry14, Cry15, Cry16, Cry17, Cry18, Cry19, Cry20, Cry21, Cry22, Cry23, Cry24, Cry25, Cry26, Cry27, Cry 28, Cry 29, Cry 30, Cry31, Cry32, Cry33, Cry34, Cry35, Cry36, Cry37, Cry38, Cry39, Cry40, Cry41, Cry42, Cry43, Cry44, Cry45, Cry 46, Cry47, Cry49, Cry50, Cry51, Cry52, Cry53, Cry 54, Cry55, Cry56, Cry57, Cry58, Cry59, Cry60, Cry61, Cry62, Cry63, Cry64, Cry65, Cry66, Cry67, Cry68, Cry69, Cry70, Cry71, Cry72, Cry73, and Cry 74 classes of δ-endotoxin genes and the *B. thuringiensis* cytolytic cyt1 and cyt2 genes. Members of these classes of *B. thuringiensis* insecticidal proteins well known to one skilled in the art (see, Crickmore, et al., "*Bacillus thuringiensis* toxin nomenclature" (2011), at lifesci.sussex.ac.uk/home/Neil_Crickmore/Bt/which can be accessed on the world-wide web using the "www" prefix).

Examples of δ-endotoxins also include but are not limited to Cry1A proteins of U.S. Pat. Nos. 5,880,275 and 7,858,849; a DIG-3 or DIG-11 toxin (N-terminal deletion of α-helix 1 and/or α-helix 2 variants of cry proteins such as Cry1A, Cry3A) of U.S. Pat. Nos. 8,304,604, 8,304,605, 8,476,226, and 9,006,520; Cry1B of U.S. Patent Application Publication Number 2006/0112447; Cry1C of U.S. Pat. No. 6,033,874; Cry1F of U.S. Pat. Nos. 5,188,960 and 6,218,188; Cry1A/F chimeras of U.S. Pat. Nos. 7,070,982; 6,962,705 and 6,713,063); a Cry2 protein such as Cry2Ab protein of U.S. Pat. No. 7,064,249); a Cry3A protein including but not limited to an engineered hybrid insecticidal protein (eHIP) created by fusing unique combinations of variable regions and conserved blocks of at least two different Cry proteins (US Patent Application Publication Number 2010/0017914); a Cry4 protein; a Cry5 protein; a Cry6 protein; Cry8 proteins of U.S. Pat. Nos. 7,329,736, 7,449,552, 7,803,943, 7,476,781, 7,105,332, 7,378,499 and 7,462,760; a Cry9 protein such as such as members of the Cry9A, Cry9B, Cry9C, Cry9D, Cry9E and Cry9F families; a Cry15 protein of Naimov, et al., (2008) *Applied and Environmental Microbiology*, 74:7145-7151; a Cry22, a Cry34Ab1 protein of U.S. Pat. Nos. 6,127,180, 6,624,145 and 6,340,593; a CryET33 and cryET34 protein of U.S. Pat. Nos. 6,248,535, 6,326,351, 6,399,330, 6,949,626, 7,385,107 and 7,504,229; a CryET33 and CryET34 homologs of U.S. Pat. No. 8,796,026, US Patent Publication Number 2012/0278954, and PCT Publication Number WO 2012/139,004; a Cry35Ab1 protein of U.S. Pat. Nos. 6,083,499, 6,548,291 and 6,340,593; a Cry46 protein, a Cry 51 protein, a Cry binary toxin; a TIC901 or related toxin; TIC807 of U.S. Pat. No. 8,609,936; ET29, ET37, TIC809, TIC810, TIC812, TIC127, TIC128 of WO 2007/027,776; AXMI-027, AXMI-036, and AXMI-038 of U.S. Pat. No. 8,236,757; AXMI-031, AXMI-039, AXMI-040, AXMI-049 of U.S. Pat. No. 7,923,602; AXMI-018, AXMI-020 and AXMI-021 of WO 2006/083,891; AXMI-010 of WO 2005/038,032; AXMI-003 of WO 2005/021,585; AXMI-008 of U.S. Pat. No. 7,351,881; AXMI-006 of U.S. Patent Application Publication Number 2004/0216186; AXMI-007 of U.S. Patent Application Publication Number 2004/0210965; AXMI-009 of U.S. Patent Application Number 2004/0210964; AXMI-014 of U.S. Patent Application Publication Number 2004/0197917; AXMI-004 of U.S. Pat. No. 7,355,099; AXMI-028 and AXMI-029 of WO 2006/119,457, U.S. Pat. Nos. 7,622,572, 7,803,925, 7,803,391, 7,811,598, 8,314,292; AXMI-007, AXMI-008, AXMI-0080, AXMI-009, AXMI-014 and AXMI-004 of WO 2004/074, 462; AXMI-150 of U.S. Pat. No. 8,084,416; AXMI-205 of US Patent Application Publication Number 2011/0023184; AXMI-011, AXMI-012, AXMI-013, AXMI-015, AXMI-019, AXMI-044, AXMI-037, AXMI-043, AXMI-033, AXMI-034, AXMI-022, AXMI-023, AXMI-041, AXMI-063 and AXMI-064 of U.S. Pat. No. 8,829,279 or U.S. Patent Publication Number US20140344999; AXMI-R1 and related proteins of U.S. Pat. No. 8,299,217; AXMI221Z, AXMI222z, AXMI223z, AXMI224z and AXMI225z of U.S. Pat. No. 8,686,124; AXMI218, AXMI219, AXMI220, AXMI226, AXMI227, AXMI228, AXMI229, AXMI230 and AXMI231 of U.S. Pat. No. 8,759,619; AXMI-115, AXMI-113, AXMI-005, AXMI-163 and AXMI-184 of U.S. Pat. No. 8,334,431; AXMI-001, AXMI-002, AXMI-030, AXMI-035 and AXMI-045 of US Patent Application Publication Number 2013/0117884; AXMI-066 and AXMI-076 of US Patent Application Publication Number 2009/0144852; AXMI128, AXMI130, AXMI131, AXMI133, AXMI140, AXMI141, AXMI142, AXMI143, AXMI144, AXMI146, AXMI148, AXMI149, AXMI152, AXMI153, AXMI154, AXMI155, AXMI156, AXMI157, AXMI158, AXMI162, AXMI165, AXMI166, AXMI167, AXMI168, AXMI169, AXMI170, AXMI171, AXMI172, AXMI173, AXMI174, AXMI175, AXMI176, AXMI177, AXMI178, AXMI179, AXMI180, AXMI181, AXMI182, AXMI185, AXMI186, AXMI187, AXMI188, AXMI189 of U.S. Pat. No. 8,318,900 or U.S. Patent Publication Number 2013/0055469; AXMI079, AXMI080, AXMI081, AXMI082, AXMI091, AXMI092, AXMI096, AXMI097, AXMI098, AXMI099, AXMI100, AXMI101, AXMI102, AXMI103, AXMI104, AXMI107, AXMI108, AXMI109, AXMI110, AXMI111, AXMI112, AXMI114, AXMI116, AXMI117, AXMI118, AXMI119, AXMI120, AXMI121, AXMI122, AXMI123, AXMI124, AXMI1257, AXMI1268, AXMI127, AXMI129, AXMI164, AXMI151, AXMI161, AXMI183, AXMI132, AXMI138, AXMI137 of U.S. Pat. No. 8,461,421 and U.S. Patent Publication Number 2013/0305412, cry proteins such as Cry1A and Cry3A having modified proteolytic sites of U.S. Pat. No. 8,319,019; a Cry1Ac, Cry2Aa and Cry1Ca toxin protein from *Bacillus thuringiensis* strain VBTS 2528 of U.S. Pat. No. 8,551,757. The insecticidal activity of Cry proteins is well known to one skilled in the art (for review, see, van Frannkenhuyzen, (2009) *J. Invert. Path.* 101:1-16). The use of Cry proteins as transgenic plant traits is well known to one skilled in the art and Cry-transgenic plants including but not limited to plants expressing Cry1Ac, Cry1Ac+Cry2Ab, Cry1Ab, Cry1A.105, Cry1F, Cry1Fa2, Cry1F+Cry1Ac, Cry2Ab, Cry3A, mCry3A, Cry3Bb1, Cry34Ab1, Cry35Ab1, Vip3A, mCry3A, Cry9c and CBI-Bt have received regulatory approval (see, Sanahuja, (2011) *Plant Biotech Journal* 9:283-300 and the CERA. (2010) GM Crop Database Center for Environmental Risk Assessment (CERA), ILSI Research Foundation, Washington D.C. at cera-gmc.org/index.php?action=gm_crop_database which can be accessed on the world-wide web using the "www" prefix). More than one pesticidal proteins well known to one skilled in the art can also be expressed in plants such as Vip3Ab & Cry1Fa (US2012/0317682); Cry1BE & Cry1F (US2012/0311746); Cry1CA & Cry1AB (US2012/0311745); Cry1F & CryCa (US2012/0317681); Cry1DA & Cry1BE (US2012/0331590); Cry1DA & Cry1Fa (US2012/0331589); Cry1AB & Cry1BE (US2012/0324606); Cry1Fa & Cry2Aa and Cry1I & Cry1E (US2012/0324605); Cry34Ab/35Ab and Cry6Aa (US20130167269); Cry34Ab/VCry35Ab & Cry3Aa (US20130167268); and Cry3A and Cry1Ab or Vip3Aa (US20130116170). Pesticidal proteins also include insecticidal lipases including lipid acyl hydrolases of U.S. Pat. No. 7,491,869, and cholesterol oxidases such as from *Streptomyces* (Purcell et al. (1993) *Biochem Biophys Res Commun* 15:1406-1413). Pesticidal proteins also include VIP (vegetative insecticidal proteins) toxins of U.S. Pat. Nos. 5,877,012, 6,107,279 6,137,033, 7,244,820, 7,615,686, and 8,237,020 and the like. Other VIP proteins are well known to one skilled in the art (see, lifesci.sussex.ac.uk/home/Neil_Crickmore/Bt/vip.html which can be accessed on the world-wide web using the "www" prefix). Pesticidal proteins also include toxin complex (TC) proteins, obtainable from organisms such as *Xenorhabdus, Photorhabdus* and *Paenibacillus* (see, U.S. Pat. Nos. 7,491,698 and 8,084,418). Some TC proteins have "stand alone" insecticidal activity and other TC proteins enhance the activity of the stand-alone toxins produced by the same given organism. The toxicity of a "stand-alone" TC protein (from *Photorhabdus, Xenorhabdus* or *Paenibacillus*, for example) can be enhanced by one or more TC protein "potentiators" derived from a source organism of a different genus. There are three main types of TC proteins. As referred to herein, Class A proteins ("Protein A") are stand-alone toxins. Class B proteins ("Protein B") and Class C proteins ("Protein C") enhance the toxicity of Class A proteins. Examples of Class A proteins are TcbA, TcdA, XptA1 and XptA2. Examples of Class B proteins are TcaC, TcdB, XptB1Xb and XptC1Wi. Examples of Class C proteins are TccC, XptC1Xb and XptB1Wi. Pesticidal proteins also include spider, snake and scorpion venom proteins. Examples of spider venom peptides include but not limited to lycotoxin-1 peptides and mutants thereof (U.S. Pat. No. 8,334,366).

(C) A polynucleotide encoding an insect-specific hormone or pheromone such as an ecdysteroid and juvenile hormone, a variant thereof, a mimetic based thereon or an antagonist or agonist thereof. See, for example, the disclosure by Hammock, et al., (1990) *Nature* 344:458, of baculovirus expression of cloned juvenile hormone esterase, an inactivator of juvenile hormone.

(D) A polynucleotide encoding an insect-specific peptide which, upon expression, disrupts the physiology of the affected pest. For example, see the disclosures of, Regan, (1994) *J. Biol. Chem.* 269:9 (expression cloning yields DNA coding for insect diuretic hormone receptor); Pratt, et al., (1989) *Biochem. Biophys. Res. Comm.* 163:1243 (an allostatin is identified in *Diploptera puntata*); Chattopadhyay, et al., (2004) *Critical Reviews in Microbiology* 30(1):33-54; Zjawiony, (2004) *J Nat Prod* 67(2):300-310; Carlini and Grossi-de-Sa, (2002) *Toxicon* 40(11):1515-1539; Ussuf, et al., (2001) *Curr Sci.* 80(7):847-853 and Vasconcelos and Oliveira, (2004) *Toxicon* 44(4):385-403. See also, U.S. Pat. No. 5,266,317 to Tomalski, et al., who disclose genes encoding insect-specific toxins.

(E) A polynucleotide encoding an enzyme responsible for a hyperaccumulation of a monoterpene, a sesquiterpene, a steroid, hydroxamic acid, a phenylpropanoid derivative or another non-protein molecule with insecticidal activity.

(F) A polynucleotide encoding an enzyme involved in the modification, including the post-translational modification, of a biologically active molecule; for example, a glycolytic enzyme, a proteolytic enzyme, a lipolytic enzyme, a nuclease, a cyclase, a transaminase, an esterase, a hydrolase, a phosphatase, a kinase, a phosphorylase, a polymerase, an elastase, a chitinase and a glucanase, whether natural or synthetic. See, PCT Application WO 1993/02197 in the name of Scott, et al., which discloses the nucleotide sequence of a callase gene. DNA molecules which contain chitinase-encoding sequences can be obtained, for example, from the ATCC® under Accession Numbers 39637 and 67152. See also, Kramer, et al., (1993) *Insect Biochem. Molec. Biol.* 23:691, who teach the nucleotide sequence of a cDNA encoding tobacco hookworm chitinase and Kawalleck, et al., (1993) *Plant Molec. Biol.* 21:673, who provide the nucleotide sequence of the parsley ubi4-2 polyubiquitin gene, and U.S. Pat. Nos. 6,563,020; 7,145,060 and 7,087,810.

(G) A polynucleotide encoding a molecule that stimulates signal transduction. For example, see the disclosure by Botella, et al., (1994) *Plant Molec. Biol.* 24:757, of nucleotide sequences for mung bean calmodulin cDNA clones, and Griess, et al., (1994) *Plant Physiol.* 104:1467, who provide the nucleotide sequence of a maize calmodulin cDNA clone.

(H) A polynucleotide encoding a hydrophobic moment peptide. See, PCT Application WO 1995/16776 and U.S.

Pat. No. 5,580,852 disclosure of peptide derivatives of Tachyplesin which inhibit fungal plant pathogens) and PCT Application WO 1995/18855 and U.S. Pat. No. 5,607,914 (teaches synthetic antimicrobial peptides that confer disease resistance).

(I) A polynucleotide encoding a membrane permease, a channel former or a channel blocker. For example, see the disclosure by Jaynes, et al., (1993) *Plant Sci.* 89:43, of heterologous expression of a cecropin-beta lytic peptide analog to render transgenic tobacco plants resistant to *Pseudomonas solanacearum*.

(J) A gene encoding a viral-invasive protein or a complex toxin derived therefrom. For example, the accumulation of viral coat proteins in transformed plant cells imparts resistance to viral infection and/or disease development effected by the virus from which the coat protein gene is derived, as well as by related viruses. See, Beachy, et al., (1990) *Ann. Rev. Phytopathol.* 28:451. Coat protein-mediated resistance has been conferred upon transformed plants against alfalfa mosaic virus, cucumber mosaic virus, tobacco streak virus, potato virus X, potato virus Y, tobacco etch virus, tobacco rattle virus and tobacco mosaic virus. Id.

(K) A gene encoding an insect-specific antibody or an immunotoxin derived therefrom. Thus, an antibody targeted to a critical metabolic function in the insect gut would inactivate an affected enzyme, killing the insect. Cf. Taylor, et al., Abstract #497, SEVENTH INT'L SYMPOSIUM ON MOLECULAR PLANT-MICROBE INTERACTIONS (Edinburgh, Scotland, 1994) (enzymatic inactivation in transgenic tobacco via production of single-chain antibody fragments).

(L) A gene encoding a virus-specific antibody. See, for example, Tavladoraki, et al., (1993) *Nature* 366:469, who show that transgenic plants expressing recombinant antibody genes are protected from virus attack.

(M) A polynucleotide encoding a developmental-arrestive protein produced in nature by a pathogen or a parasite. Thus, fungal endo alpha-1,4-D-polygalacturonases facilitate fungal colonization and plant nutrient release by solubilizing plant cell wall homo-alpha-1,4-D-galacturonase. See, Lamb, et al., (1992) *Bio/Technology* 10:1436. The cloning and characterization of a gene which encodes a bean endopolygalacturonase-inhibiting protein is described by Toubart, et al., (1992) *Plant J.* 2:367.

(N) A polynucleotide encoding a developmental-arrestive protein produced in nature by a plant. For example, Logemann, et al., (1992) *Bio/Technology* 10:305, have shown that transgenic plants expressing the barley ribosome-inactivating gene have an increased resistance to fungal disease.

(O) Genes involved in the Systemic Acquired Resistance (SAR) Response and/or the pathogenesis related genes. Briggs, (1995) *Current Biology* 5(2), Pieterse and Van Loon, (2004) *Curr. Opin. Plant Bio.* 7(4):456-64 and Somssich, (2003) *Cell* 113(7):815-6.

(P) Antifungal genes (Cornelissen and Melchers, (1993) *Pl. Physiol.* 101:709-712 and Parijs, et al., (1991) *Planta* 183:258-264 and Bushnell, et al., (1998) *Can. J. of Plant Path.* 20(2):137-149. Also see, U.S. patent application Ser. Nos. 09/950,933; 11/619,645; 11/657,710; 11/748,994; 11/774,121 and U.S. Pat. Nos. 6,891,085 and 7,306,946. LysM Receptor-like kinases for the perception of chitin fragments as a first step in plant defense response against fungal pathogens (US 2012/0110696).

(Q) Detoxification genes, such as for fumonisin, beauvericin, moniliformin and zearalenone and their structurally related derivatives. For example, see, U.S. Pat. Nos. 5,716,820; 5,792,931; 5,798,255; 5,846,812; 6,083,736; 6,538,177; 6,388,171 and 6,812,380.

(R) A polynucleotide encoding a Cystatin and cysteine proteinase inhibitors. See, U.S. Pat. No. 7,205,453.

(S) Defensin genes. See, WO 2003/000,863 and U.S. Pat. Nos. 6,911,577; 6,855,865; 6,777,592 and 7,238,781.

(T) Genes conferring resistance to nematodes. See, e.g., PCT Application WO 1996/30517; PCT Application WO 1993/19181, WO 2003/033,651 and Urwin, et al., (1998) *Planta* 204:472-479, Williamson, (1999) *Curr Opin Plant Bio.* 2(4):327-31; U.S. Pat. Nos. 6,284,948 and 7,301,069 and miR164 genes (WO 2012/058,266).

(U) Genes that confer resistance to *Phytophthora* Root Rot, such as the Rps 1, Rps 1-a, Rps 1-b, Rps 1-c, Rps 1-d, Rps 1-e, Rps 1-k, Rps 2, Rps 3-a, Rps 3-b, Rps 3-c, Rps 4, Rps 5, Rps 6, Rps 7 and other Rps genes. See, for example, Shoemaker, et al., *Phytophthora* Root Rot Resistance Gene Mapping in Soybean, Plant Genome IV Conference, San Diego, Calif. (1995).

(V) Genes that confer resistance to Brown Stem Rot, such as described in U.S. Pat. No. 5,689,035 and incorporated by reference for this purpose.

(W) Genes that confer resistance to *Colletotrichum*, such as described in US Patent Application Publication U.S. 2009/0035765 and incorporated by reference for this purpose. This includes the Rcg locus that may be utilized as a single locus conversion.

2. Transgenes that Confer Resistance to a Herbicide, for Example:

(A) A polynucleotide encoding resistance to a herbicide that inhibits the growing point or meristem, such as an imidazolinone or a sulfonylurea. Exemplary genes in this category code for mutant ALS and AHAS enzyme as described, for example, by Lee, et al., (1988) *EMBO J.* 7:1241 and Miki, et al., (1990) *Theor. Appl. Genet.* 80:449, respectively. See also, U.S. Pat. Nos. 5,605,011; 5,013,659; 5,141,870; 5,767,361; 5,731,180; 5,304,732; 4,761,373; 5,331,107; 5,928,937 and 5,378,824; U.S. patent application Ser. No. 11/683,737 and International Publication WO 1996/33270.

(B) A polynucleotide encoding a protein for resistance to Glyphosate (resistance imparted by mutant 5-enolpyruvl-3-phosphikimate synthase (EPSP) and aroA genes, respectively) and other phosphono compounds such as glufosinate (phosphinothricin acetyl transferase (PAT) and *Streptomyces hygroscopicus* phosphinothricin acetyl transferase (bar) genes), and pyridinoxy or phenoxy proprionic acids and cyclohexones (ACCase inhibitor-encoding genes). See, for example, U.S. Pat. No. 4,940,835 to Shah, et al., which discloses the nucleotide sequence of a form of EPSPS which can confer glyphosate resistance. U.S. Pat. No. 5,627,061 to Barry, et al., also describes genes encoding EPSPS enzymes. See also, U.S. Pat. Nos. 6,566,587; 6,338,961; 6,248,876; 6,040,497; 5,804,425; 5,633,435; 5,145,783; 4,971,908; 5,312,910; 5,188,642; 5,094,945, 4,940,835; 5,866,775; 6,225,114; 6,130,366; 5,310,667; 4,535,060; 4,769,061; 5,633,448; 5,510,471; Re. 36,449; RE 37,287 E and 5,491,288 and International Publications EP 1173580; WO 2001/66704; EP 1173581 and EP 1173582, which are incorporated herein by reference for this purpose. Glyphosate resistance is also imparted to plants that express a gene encoding a glyphosate oxido-reductase enzyme as described more fully in U.S. Pat. Nos. 5,776,760 and 5,463,175, which are incorporated herein by reference for this purpose. In addition glyphosate resistance can be imparted to plants by the over expression of genes encoding glyphosate N-acetyltransferase. See, for example, U.S. Pat. Nos. 7,462,481; 7,405,074 and US Patent Application Publication Number U.S. 2008/0234130. A DNA molecule encoding a mutant aroA gene can be obtained under ATCC® Accession Number 39256, and the nucleotide sequence of the mutant gene is disclosed in U.S. Pat. No. 4,769,061 to Comai. EP Application Number 0 333 033 to Kumada, et al., and U.S. Pat. No. 4,975,374 to Goodman, et al., disclose nucleotide sequences of glutamine synthetase genes which confer resistance to herbicides such as L-phosphinothricin. The nucleotide sequence of a phosphinothricin-acetyl-transferase gene is provided in EP Application Numbers 0 242 246 and 0 242 236 to Leemans, et al.; De Greef, et al., (1989) *Bio/Technology* 7:61, describe the production of transgenic plants that express chimeric bar genes coding for phosphinothricin acetyl transferase activity. See also, U.S. Pat. Nos. 5,969,213; 5,489,520; 5,550,318; 5,874,265; 5,919,675; 5,561,236; 5,648,477; 5,646,024; 6,177,616, and 5,879,903, which are incorporated herein by reference for this purpose. Exemplary genes conferring resistance to phenoxy proprionic acids and cyclohexones, such as sethoxydim and haloxyfop, are the Acc1-S1, Acc1-S2 and Acc1-S3 genes described by Marshall, et al., (1992) *Theor. Appl. Genet.* 83:435.

(C) A polynucleotide encoding a protein for resistance to herbicide that inhibits photosynthesis, such as a triazine (psbA and gs+ genes) and a benzonitrile (nitrilase gene). Przibilla, et al., (1991) Plant Cell 3:169, describe the transformation of *Chlamydomonas* with plasmids encoding mutant psbA genes. Nucleotide sequences for nitrilase genes are disclosed in U.S. Pat. No. 4,810,648 to Stalker and DNA molecules containing these genes are available under ATCC® Accession Numbers 53435, 67441 and 67442. Cloning and expression of DNA coding for a glutathione S-transferase is described by Hayes, et al., (1992) *Biochem. J.* 285:173.

(D) A polynucleotide encoding a protein for resistance to Acetohydroxy acid synthase, which has been found to make plants that express this enzyme resistant to multiple types of herbicides, has been introduced into a variety of plants (see, e.g., Hattori, et al., (1995) *Mol Gen Genet.* 246:419). Other genes that confer resistance to herbicides include: a gene encoding a chimeric protein of rat cytochrome P4507A1 and yeast NADPH-cytochrome P450 oxidoreductase (Shiota, et al., (1994) *Plant Physiol* 106:17), genes for glutathione reductase and superoxide dismutase (Aono, et al., (1995) *Plant Cell Physiol* 36:1687) and genes for various phosphotransferases (Datta, et al., (1992) *Plant Mol Biol* 20:619).

(E) A polynucleotide encoding resistance to a herbicide targeting Protoporphyrinogen oxidase (protox) which is necessary for the production of chlorophyll. The protox enzyme serves as the target for a variety of herbicidal compounds. These herbicides also inhibit growth of all the different species of plants present, causing their total destruction. The development of plants containing altered protox activity which are resistant to these herbicides are described in U.S. Pat. Nos. 6,288,306, 6,282,837, and 5,767,373 and International Publication WO 2001/12825.

(F) The aad-1 gene (originally from *Sphingobium herbicidovorans*) encodes the aryloxyalkanoate dioxygenase (AAD-1) protein. The trait confers tolerance to 2,4-dichlorophenoxyacetic acid and aryloxyphenoxypropionate (commonly referred to as "fop" herbicides such as quizalofop) herbicides. The aad-1 gene, itself, for herbicide tolerance in plants was first disclosed in WO 2005/107,437 (see also, U.S. 2009/0093366). The aad-12 gene, derived from *Delftia acidovorans*, which encodes the aryloxyalkanoate dioxygenase (AAD-12) protein that confers tolerance to 2,4-dichlorophenoxyacetic acid and pyridyloxyacetate herbicides by deactivating several herbicides with an aryloxyalkanoate moiety, including phenoxy auxin (e.g., 2,4-D, MCPA), as well as pyridyloxy auxins (e.g., fluroxypyr, triclopyr).

(G) A polynucleotide encoding a herbicide resistant dicamba monooxygenase disclosed in U.S. Patent Application Publication 2003/0135879 for imparting dicamba tolerance;

(H) A polynucleotide molecule encoding bromoxynil nitrilase (Bxn) disclosed in U.S. Pat. No. 4,810,648 for imparting bromoxynil tolerance;

(I) A polynucleotide molecule encoding phytoene (crtI) described in Misawa, et al., (1993) *Plant J.* 4:833-840 and in Misawa, et al., (1994) *Plant J.* 6:481-489 for norflurazon tolerance.

3. Transgenes that Confer or Contribute to an Altered Grain Characteristic Such as:

(A) Altered fatty acids, for example, by (1) Down-regulation of stearoyl-ACP to increase stearic acid content of the plant. See, Knultzon, et al., (1992) *Proc. Natl. Acad. Sci. USA* 89:2624 and WO 1999/64579 (Genes to Alter Lipid Profiles in Corn).

(2) Elevating oleic acid via FAD-2 gene modification and/or decreasing linolenic acid via FAD-3 gene modification (see, U.S. Pat. Nos. 6,063,947; 6,323,392; 6,372,965 and WO 1993/11245).

(3) Altering conjugated linolenic or linoleic acid content, such as in WO 2001/12800.

(4) Altering LEC1, AGP, Dek1, Superal1, mi1 ps, various Ipa genes such as Ipa1, Ipa3, hpt or hggt. For example, see, WO 2002/42424, WO 1998/22604, WO 2003/011,015, WO 2002/057,439, WO 2003/011,015, U.S. Pat. Nos. 6,423,886, 6,197,561, 6,825,397 and U.S. Patent Application Publication Numbers U.S. 2003/0079247, US 2003/0204870 and Rivera-Madrid, et al., (1995) *Proc. Natl. Acad. Sci.* 92:5620-5624.

(5) Genes encoding delta-8 desaturase for making long-chain polyunsaturated fatty acids (U.S. Pat. Nos. 8,058,571 and 8,338,152), delta-9 desaturase for lowering saturated fats (U.S. Pat. No. 8,063,269), Primula Δ6-desaturase for improving omega-3 fatty acid profiles.

(6) Isolated nucleic acids and proteins associated with lipid and sugar metabolism regulation, in particular, lipid metabolism protein (LMP) used in methods of producing transgenic plants and modulating levels of seed storage compounds including lipids, fatty acids, starches or seed storage proteins and use in methods of modulating the seed size, seed number, seed weights, root length and leaf size of plants (EP 2404499).

(7) Altering expression of a High-Level Expression of Sugar-Inducible 2 (HSI2) protein in the plant to increase or decrease expression of HSI2 in the plant. Increasing expression of HSI2 increases oil content while decreasing expression of HSI2 decreases abscisic acid sensitivity and/or increases drought resistance (US Patent Application Publication Number 2012/0066794).

(8) Expression of cytochrome b5 (Cb5) alone or with FAD2 to modulate oil content in plant seed, particularly to increase the levels of omega-3 fatty acids and improve the ratio of omega-6 to omega-3 fatty acids (US Patent Application Publication Number 2011/0191904).

(9) Nucleic acid molecules encoding wrinkled1-like polypeptides for modulating sugar metabolism (U.S. Pat. No. 8,217,223).

(B) Altered phosphorus content, for example, by the (1) Introduction of a phytase-encoding gene would enhance breakdown of phytate, adding more free phosphate to the transformed plant. For example, see, Van Hartingsveldt, et al., (1993) *Gene* 127:87, for a disclosure of the nucleotide sequence of an *Aspergillus niger* phytase gene.

(2) Modulating a gene that reduces phytate content. In maize, this, for example, could be accomplished, by cloning and then re-introducing DNA associated with one or more of the alleles, such as the LPA alleles, identified in maize mutants characterized by low levels of phytic acid, such as in WO 2005/113,778 and/or by altering inositol kinase activity as in WO 2002/059,324, U.S. Patent Application Publication Number 2003/0009011, WO 2003/027,243, U.S. Patent Application Publication Number 2003/0079247, WO 1999/05298, U.S. Pat. Nos. 6,197,561, 6,291,224, 6,391,348, WO 2002/059,324, U.S. Patent Application Publication Number 2003/0079247, WO 1998/45448, WO 1999/55882, WO 2001/04147.

(C) Altered carbohydrates affected, for example, by altering a gene for an enzyme that affects the branching pattern of starch or, a gene altering thioredoxin such as NTR and/or TRX (see, U.S. Pat. No. 6,531,648, which is incorporated by reference for this purpose) and/or a gamma zein knock out or mutant such as cs27 or TUSC27 or en27 (see, U.S. Pat. No. 6,858,778 and U.S. Patent Application Publication Number 2005/0160488, U.S. Patent Application Publication Number 2005/0204418, which are incorporated by reference for this purpose). See, Shiroza, et al., (1988) *J. Bacteriol.* 170:810 (nucleotide sequence of *Streptococcus* mutant fructosyltransferase gene), Steinmetz, et al., (1985) *Mol. Gen. Genet.* 200:220 (nucleotide sequence of *Bacillus subtilis* levansucrase gene), Pen, et al., (1992) *Bio/Technology* 10:292 (production of transgenic plants that express *Bacillus licheniformis* alpha-amylase), Elliot, et al., (1993) *Plant Molec. Biol.* 21:515 (nucleotide sequences of tomato invertase genes), Søgaard, et al., (1993) *J. Biol. Chem.* 268:22480 (site-directed mutagenesis of barley alpha-amylase gene) and Fisher, et al., (1993) *Plant Physiol.* 102:1045 (maize endosperm starch branching enzyme II), WO 1999/10498 (improved digestibility and/or starch extraction through modification of UDP-D-xylose 4-epimerase, Fragile 1 and 2, Ref1, HCHL, C4H), U.S. Pat. No. 6,232,529 (method of producing high oil seed by modification of starch levels (AGP)). The fatty acid modification genes mentioned herein may also be used to affect starch content and/or composition through the interrelationship of the starch and oil pathways.

(D) Altered antioxidant content or composition, such as alteration of tocopherol or tocotrienols. For example, see, U.S. Pat. No. 6,787,683, U.S. Patent Application Publication Number 2004/0034886 and WO 2000/68393 involving the manipulation of antioxidant levels and WO 2003/082,899 through alteration of a homogentisate geranyl geranyl transferase (hggt).

(E) Altered essential seed amino acids. For example, see, U.S. Pat. No. 6,127,600 (method of increasing accumulation of essential amino acids in seeds), U.S. Pat. No. 6,080,913 (binary methods of increasing accumulation of essential amino acids in seeds), U.S. Pat. No. 5,990,389 (high lysine), WO 1999/40209 (alteration of amino acid compositions in seeds), WO 1999/29882 (methods for altering amino acid content of proteins), U.S. Pat. No. 5,850,016 (alteration of amino acid compositions in seeds), WO 1998/20133 (proteins with enhanced levels of essential amino acids), U.S. Pat. No. 5,885,802 (high methionine), U.S. Pat. No. 5,885,801 (high threonine), U.S. Pat. No. 6,664,445 (plant amino acid biosynthetic enzymes), U.S. Pat. No. 6,459,019 (increased lysine and threonine), U.S. Pat. No. 6,441,274 (plant tryptophan synthase beta subunit), U.S. Pat. No. 6,346,403 (methionine metabolic enzymes), U.S. Pat. No. 5,939,599 (high sulfur), U.S. Pat. No. 5,912,414 (increased methionine), WO 1998/56935 (plant amino acid biosynthetic enzymes), WO 1998/45458 (engineered seed protein having higher percentage of essential amino acids), WO 1998/42831 (increased lysine), U.S. Pat. No. 5,633,436 (increasing sulfur amino acid content), U.S. Pat. No. 5,559,223 (synthetic storage proteins with defined structure containing programmable levels of essential amino acids for improvement of the nutritional value of plants), WO 1996/01905 (increased threonine), WO 1995/15392 (increased lysine), U.S. Patent Application Publication Number 2003/0163838, U.S. Patent Application Publication Number 2003/0150014, U.S. Patent Application Publication Number 2004/0068767, U.S. Pat. No. 6,803,498, WO 2001/79516.

4. Genes that Control Male-Sterility:

There are several methods of conferring genetic male sterility available, such as multiple mutant genes at separate locations within the genome that confer male sterility, as disclosed in U.S. Pat. Nos. 4,654,465 and 4,727,219 to Brar, et al., and chromosomal translocations as described by Patterson in U.S. Pat. Nos. 3,861,709 and 3,710,511. In addition to these methods, Albertsen, et al., U.S. Pat. No. 5,432,068, describe a system of nuclear male sterility which includes: identifying a gene which is critical to male fertility; silencing this native gene which is critical to male fertility; removing the native promoter from the essential male fertility gene and replacing it with an inducible promoter; inserting this genetically engineered gene back into the plant; and thus creating a plant that is male sterile because the inducible promoter is not "on" resulting in the male fertility gene not being transcribed. Fertility is restored by inducing or turning "on" the promoter, which in turn allows the gene that confers male fertility to be transcribed.

(A) Introduction of a deacetylase gene under the control of a tapetum-specific promoter and with the application of the chemical N—Ac—PPT (WO 2001/29237).

(B) Introduction of various stamen-specific promoters (WO 1992/13956, WO 1992/13957).

(C) Introduction of the barnase and the barstar gene (Paul, et al., (1992) *Plant Mol. Biol.* 19:611-622).

For additional examples of nuclear male and female sterility systems and genes, see also, U.S. Pat. Nos. 5,859,341; 6,297,426; 5,478,369; 5,824,524; 5,850,014 and 6,265,640, all of which are hereby incorporated by reference.

5. Genes that Create a Site for Site Specific DNA Integration.

This includes the introduction of FRT sites that may be used in the FLP/FRT system and/or Lox sites that may be used in the Cre/Loxp system. For example, see, Lyznik, et al., (2003) *Plant Cell Rep* 21:925-932 and WO 1999/25821, which are hereby incorporated by reference. Other systems that may be used include the Gin recombinase of phage Mu (Maeser, et al., (1991) Vicki Chandler, The Maize Handbook ch. 118 (Springer-Verlag 1994), the Pin recombinase of *E. coli* (Enomoto, et al., 1983) and the R/RS system of the pSRi plasmid (Araki, et al., 1992).

6. Genes that Affect Abiotic Stress Resistance

Including but not limited to flowering, ear and seed development, enhancement of nitrogen utilization efficiency, altered nitrogen responsiveness, drought resistance or tolerance, cold resistance or tolerance and salt resistance or tolerance and increased yield under stress.

(A) For example, see: WO 2000/73475 where water use efficiency is altered through alteration of malate; U.S. Pat. Nos. 5,892,009, 5,965,705, 5,929,305, 5,891,859, 6,417,428, 6,664,446, 6,706,866, 6,717,034, 6,801,104, WO 2000/

060,089, WO 2001/026,459, WO 2001/035,725, WO 2001/034,726, WO 2001/035,727, WO 2001/036,444, WO 2001/036,597, WO 2001/036,598, WO 2002/015,675, WO 2002/017,430, WO 2002/077,185, WO 2002/079,403, WO 2003/013,227, WO 2003/013,228, WO 2003/014,327, WO 2004/031,349, WO 2004/076,638, WO 199809521.

(B) WO 199938977 describing genes, including CBF genes and transcription factors effective in mitigating the negative effects of freezing, high salinity and drought on plants, as well as conferring other positive effects on plant phenotype.

(C) U.S. Patent Application Publication Number 2004/0148654 and WO 2001/36596 where abscisic acid is altered in plants resulting in improved plant phenotype such as increased yield and/or increased tolerance to abiotic stress.

(D) WO 2000/006,341, WO 2004/090,143, U.S. Pat. Nos. 7,531,723 and 6,992,237 where cytokine expression is modified resulting in plants with increased stress tolerance, such as drought tolerance, and/or increased yield. Also see, WO 2002/02776, WO 2003/052,063, JP 2002/281,975, U.S. Pat. No. 6,084,153, WO 2001/64898, U.S. Pat. Nos. 6,177,275 and 6,107,547 (enhancement of nitrogen utilization and altered nitrogen responsiveness).

(E) For ethylene alteration, see, U.S. Patent Application Publication Number 2004/0128719, U.S. Patent Application Publication Number 2003/0166197 and WO 2000/32761.

(F) For plant transcription factors or transcriptional regulators of abiotic stress, see, e.g., U.S. Patent Application Publication Number 2004/0098764 or U.S. Patent Application Publication Number 2004/0078852.

(G) Genes that increase expression of vacuolar pyrophosphatase such as AVP1 (U.S. Pat. No. 8,058,515) for increased yield; nucleic acid encoding a HSFA4 or a HSFA5 (Heat Shock Factor of the class A4 or A5) polypeptides, an oligopeptide transporter protein (OPT4-like) polypeptide; a plastochron2-like (PLA2-like) polypeptide or a Wuschel related homeobox 1-like (WOX1-like) polypeptide (U. Patent Application Publication Number U.S. 2011/0283420).

(H) Down regulation of polynucleotides encoding poly (ADP-ribose) polymerase (PARP) proteins to modulate programmed cell death (U.S. Pat. No. 8,058,510) for increased vigor.

(I) Polynucleotide encoding DTP21 polypeptides for conferring drought resistance (US Patent Application Publication Number U.S. 2011/0277181).

(J) Nucleotide sequences encoding ACC Synthase 3 (ACS3) proteins for modulating development, modulating response to stress, and modulating stress tolerance (US Patent Application Publication Number U.S. 2010/0287669).

(K) Polynucleotides that encode proteins that confer a drought tolerance phenotype (DTP) for conferring drought resistance (WO 2012/058,528).

(L) Tocopherol cyclase (TC) genes for conferring drought and salt tolerance (U.S. Patent Application Publication Number 2012/0272352).

(M) CAAX amino terminal family proteins for stress tolerance (U.S. Pat. No. 8,338,661).

(N) Mutations in the SAL1 encoding gene have increased stress tolerance, including increased drought resistant (US Patent Application Publication Number 2010/0257633).

(O) Expression of a nucleic acid sequence encoding a polypeptide selected from the group consisting of: GRF polypeptide, RAA1-like polypeptide, SYR polypeptide, ARKL polypeptide, and YTP polypeptide increasing yield-related traits (US Patent Application Publication Number 2011/0061133).

(P) Modulating expression in a plant of a nucleic acid encoding a Class III Trehalose Phosphate Phosphatase (TPP) polypeptide for enhancing yield-related traits in plants, particularly increasing seed yield (US Patent Application Publication Number 2010/0024067).

Other genes and transcription factors that affect plant growth and agronomic traits such as yield, flowering, plant growth and/or plant structure, can be introduced or introgressed into plants, see e.g., WO 1997/49811 (LHY), WO 1998/56918 (ESD4), WO 1997/10339 and U.S. Pat. No. 6,573,430 (TFL), U.S. Pat. No. 6,713,663 (FT), WO 1996/14414 (CON), WO 1996/38560, WO 2001/21822 (VRN1), WO 2000/44918 (VRN2), WO 1999/49064 (GI), WO 2000/46358 (FR1), WO 1997/29123, U.S. Pat. Nos. 6,794,560, 6,307,126 (GAI), WO 1999/09174 (D8 and Rht) and WO 2004/076,638 and WO 2004/031,349 (transcription factors).

7. Genes that Confer Increased Yield (A) A transgenic crop plant transformed by a 1-Amino-Cyclopropane-1-Carboxylate Deaminase-like Polypeptide (ACCDP) coding nucleic acid, wherein expression of the nucleic acid sequence in the crop plant results in the plant's increased root growth, and/or increased yield, and/or increased tolerance to environmental stress as compared to a wild type variety of the plant (U.S. Pat. No. 8,097,769).

(B) Over-expression of maize zinc finger protein gene (Zm-ZFP1) using a seed preferred promoter has been shown to enhance plant growth, increase kernel number and total kernel weight per plant (US Patent Application Publication Number 2012/0079623).

(C) Constitutive over-expression of maize lateral organ boundaries (LOB) domain protein (Zm-LOBDP1) has been shown to increase kernel number and total kernel weight per plant (US Patent Application Publication Number 2012/0079622).

(D) Enhancing yield-related traits in plants by modulating expression in a plant of a nucleic acid encoding a VIM1 (Variant in Methylation 1)-like polypeptide or a VTC2-like (GDP—L—galactose phosphorylase) polypeptide or a DUF1685 polypeptide or an ARF6-like (Auxin Responsive Factor) polypeptide (WO 2012/038,893).

(E) Modulating expression in a plant of a nucleic acid encoding a Ste20-like polypeptide or a homologue thereof gives plants having increased yield relative to control plants (EP 2431472).

(F) Genes encoding nucleoside diphosphatase kinase (NDK) polypeptides and homologs thereof for modifying the plant's root architecture (US Patent Application Publication Number 2009/0064373).

8. Genes that Confer Plant Digestibility.

(A) Altering the level of xylan present in the cell wall of a plant by modulating expression of xylan synthase (U.S. Pat. No. 8,173,866).

In some embodiment the stacked trait may be a trait or event that has received regulatory approval including but not limited to the events with regulatory approval that are well known to one skilled in the art and can be found at the Center for Environmental Risk Assessment (cera-gmc.org/?action=gm_crop_database, which can be accessed using the www prefix) and at the International Service for the Acquisition of Agri-Biotech Applications (isaaa.org/gmapprovaldatabase/default.asp, which can be accessed using the www prefix).

Gene Silencing

In some embodiments the stacked trait may be in the form of silencing of one or more polynucleotides of interest resulting in suppression of one or more target pest polypeptides. In some embodiments the silencing is achieved through the use of a suppression DNA construct.

In some embodiments one or more polynucleotide encoding the polypeptides of the IPD079 polypeptide or fragments or variants thereof may be stacked with one or more polynucleotides encoding one or more polypeptides having insecticidal activity or agronomic traits as set forth supra and optionally may further include one or more polynucleotides providing for gene silencing of one or more target polynucleotides as discussed infra.

"Suppression DNA construct" is a recombinant DNA construct which when transformed or stably integrated into the genome of the plant, results in "silencing" of a target gene in the plant. The target gene may be endogenous or transgenic to the plant. "Silencing," as used herein with respect to the target gene, refers generally to the suppression of levels of mRNA or protein/enzyme expressed by the target gene, and/or the level of the enzyme activity or protein functionality. The term "suppression" includes lower, reduce, decline, decrease, inhibit, eliminate and prevent. "Silencing" or "gene silencing" does not specify mechanism and is inclusive, and not limited to, anti-sense, cosuppression, viral-suppression, hairpin suppression, stem-loop suppression, RNAi-based approaches and small RNA-based approaches.

A suppression DNA construct may comprise a region derived from a target gene of interest and may comprise all or part of the nucleic acid sequence of the sense strand (or antisense strand) of the target gene of interest. Depending upon the approach to be utilized, the region may be 100% identical or less than 100% identical (e.g., at least 50% or any integer between 51% and 100% identical) to all or part of the sense strand (or antisense strand) of the gene of interest.

Suppression DNA constructs are well-known in the art, are readily constructed once the target gene of interest is selected, and include, without limitation, cosuppression constructs, antisense constructs, viral-suppression constructs, hairpin suppression constructs, stem-loop suppression constructs, double-stranded RNA-producing constructs, and more generally, RNAi (RNA interference) constructs and small RNA constructs such as siRNA (short interfering RNA) constructs and miRNA (microRNA) constructs.

"Antisense inhibition" refers to the production of antisense RNA transcripts capable of suppressing the expression of the target protein.

"Antisense RNA" refers to an RNA transcript that is complementary to all or part of a target primary transcript or mRNA and that blocks the expression of a target isolated nucleic acid fragment (U.S. Pat. No. 5,107,065). The complementarity of an antisense RNA may be with any part of the specific gene transcript, i.e., at the 5' non-coding sequence, 3' non-coding sequence, introns or the coding sequence.

"Cosuppression" refers to the production of sense RNA transcripts capable of suppressing the expression of the target protein. "Sense" RNA refers to RNA transcript that includes the mRNA and can be translated into protein within a cell or in vitro. Cosuppression constructs in plants have been previously designed by focusing on overexpression of a nucleic acid sequence having homology to a native mRNA, in the sense orientation, which results in the reduction of all RNA having homology to the overexpressed sequence (see, Vaucheret, et al., (1998) *Plant J.* 16:651-659 and Gura, (2000) *Nature* 404:804-808).

Another variation describes the use of plant viral sequences to direct the suppression of proximal mRNA encoding sequences (PCT Publication WO 1998/36083).

Recent work has described the use of "hairpin" structures that incorporate all or part, of an mRNA encoding sequence in a complementary orientation that results in a potential "stem-loop" structure for the expressed RNA (PCT Publication WO 1999/53050). In this case the stem is formed by polynucleotides corresponding to the gene of interest inserted in either sense or anti-sense orientation with respect to the promoter and the loop is formed by some polynucleotides of the gene of interest, which do not have a complement in the construct. This increases the frequency of cosuppression or silencing in the recovered transgenic plants. For review of hairpin suppression, see, Wesley, et al., (2003) Methods in Molecular Biology, Plant Functional Genomics: Methods and Protocols 236:273-286.

A construct where the stem is formed by at least 30 nucleotides from a gene to be suppressed and the loop is formed by a random nucleotide sequence has also effectively been used for suppression (PCT Publication WO 1999/61632).

The use of poly-T and poly-A sequences to generate the stem in the stem-loop structure has also been described (PCT Publication WO 2002/00894).

Yet another variation includes using synthetic repeats to promote formation of a stem in the stem-loop structure. Transgenic organisms prepared with such recombinant DNA fragments have been shown to have reduced levels of the protein encoded by the nucleotide fragment forming the loop as described in PCT Publication WO 2002/00904.

RNA interference refers to the process of sequence-specific post-transcriptional gene silencing in animals mediated by short interfering RNAs (siRNAs) (Fire, et al., (1998) *Nature* 391:806). The corresponding process in plants is commonly referred to as post-transcriptional gene silencing (PTGS) or RNA silencing and is also referred to as quelling in fungi. The process of post-transcriptional gene silencing is thought to be an evolutionarily-conserved cellular defense mechanism used to prevent the expression of foreign genes and is commonly shared by diverse flora and phyla (Fire, et al., (1999) *Trends Genet.* 15:358). Such protection from foreign gene expression may have evolved in response to the production of double-stranded RNAs (dsRNAs) derived from viral infection or from the random integration of transposon elements into a host genome via a cellular response that specifically destroys homologous single-stranded RNA of viral genomic RNA. The presence of dsRNA in cells triggers the RNAi response through a mechanism that has yet to be fully characterized.

The presence of long dsRNAs in cells stimulates the activity of a ribonuclease III enzyme referred to as dicer. Dicer is involved in the processing of the dsRNA into short pieces of dsRNA known as short interfering RNAs (siRNAs) (Berstein, et al., (2001) *Nature* 409:363). Short interfering RNAs derived from dicer activity are typically about 21 to about 23 nucleotides in length and comprise about 19 base pair duplexes (Elbashir, et al., (2001) *Genes Dev.* 15:188). Dicer has also been implicated in the excision of 21- and 22-nucleotide small temporal RNAs (stRNAs) from precursor RNA of conserved structure that are implicated in translational control (Hutvagner, et al., (2001) *Science* 293:834). The RNAi response also features an endonuclease complex, commonly referred to as an RNA-induced silencing complex (RISC), which mediates cleavage of single-stranded RNA having sequence complementarity to the antisense strand of the siRNA duplex. Cleavage of the target RNA takes place in the middle of the region complementary to the antisense strand of the siRNA duplex (Elbashir, et al., (2001) *Genes Dev.* 15:188). In addition, RNA interference can also involve small RNA (e.g., miRNA) mediated gene silencing, presumably through cellular mechanisms that regulate chromatin structure and thereby prevent transcription of target gene sequences (see, e.g., Allshire, (2002) *Science* 297:1818-1819; Volpe, et al., (2002) *Science* 297: 1833-1837; Jenuwein, (2002) *Science* 297:2215-2218 and Hall, et al., (2002) *Science* 297:2232-2237). As such, miRNA molecules of the disclosure can be used to mediate gene silencing via interaction with RNA transcripts or alternately by interaction with particular gene sequences, wherein such interaction results in gene silencing either at the transcriptional or post-transcriptional level.

Methods and compositions are further provided which allow for an increase in RNAi produced from the silencing element. In such embodiments, the methods and compositions employ a first polynucleotide comprising a silencing element for a target pest sequence operably linked to a promoter active in the plant cell; and, a second polynucleotide comprising a suppressor enhancer element comprising the target pest sequence or an active variant or fragment thereof operably linked to a promoter active in the plant cell. The combined expression of the silencing element with suppressor enhancer element leads to an increased amplification of the inhibitory RNA produced from the silencing element over that achievable with only the expression of the silencing element alone. In addition to the increased amplification of the specific RNAi species itself, the methods and compositions further allow for the production of a diverse population of RNAi species that can enhance the effectiveness of disrupting target gene expression. As such, when the suppressor enhancer element is expressed in a plant cell in combination with the silencing element, the methods and composition can allow for the systemic production of RNAi throughout the plant; the production of greater amounts of RNAi than would be observed with just the silencing element construct alone; and, the improved loading of RNAi into the phloem of the plant, thus providing better control of phloem feeding insects by an RNAi approach. Thus, the various methods and compositions provide improved methods for the delivery of inhibitory RNA to the target organism. See, for example, U.S. Patent Application Publication 2009/0188008.

As used herein, a "suppressor enhancer element" comprises a polynucleotide comprising the target sequence to be suppressed or an active fragment or variant thereof. It is recognize that the suppressor enhancer element need not be identical to the target sequence, but rather, the suppressor enhancer element can comprise a variant of the target sequence, so long as the suppressor enhancer element has sufficient sequence identity to the target sequence to allow for an increased level of the RNAi produced by the silencing element over that achievable with only the expression of the silencing element. Similarly, the suppressor enhancer element can comprise a fragment of the target sequence, wherein the fragment is of sufficient length to allow for an increased level of the RNAi produced by the silencing element over that achievable with only the expression of the silencing element.

It is recognized that multiple suppressor enhancer elements from the same target sequence or from different target sequences or from different regions of the same target sequence can be employed. For example, the suppressor enhancer elements employed can comprise fragments of the target sequence derived from different region of the target sequence (i.e., from the 3'UTR, coding sequence, intron, and/or 5'UTR). Further, the suppressor enhancer element can be contained in an expression cassette, as described elsewhere herein, and in specific embodiments, the suppressor enhancer element is on the same or on a different DNA vector or construct as the silencing element. The suppressor enhancer element can be operably linked to a promoter as disclosed herein. It is recognized that the suppressor enhancer element can be expressed constitutively or alternatively, it may be produced in a stage-specific manner employing the various inducible or tissue-preferred or developmentally regulated promoters that are discussed elsewhere herein.

In specific embodiments, employing both a silencing element and the suppressor enhancer element the systemic production of RNAi occurs throughout the entire plant. In further embodiments, the plant or plant parts of the disclosure have an improved loading of RNAi into the phloem of the plant than would be observed with the expression of the silencing element construct alone and, thus provide better control of phloem feeding insects by an RNAi approach. In specific embodiments, the plants, plant parts and plant cells of the disclosure can further be characterized as allowing for the production of a diversity of RNAi species that can enhance the effectiveness of disrupting target gene expression.

In specific embodiments, the combined expression of the silencing element and the suppressor enhancer element increases the concentration of the inhibitory RNA in the plant cell, plant, plant part, plant tissue or phloem over the level that is achieved when the silencing element is expressed alone.

As used herein, an "increased level of inhibitory RNA" comprises any statistically significant increase in the level of RNAi produced in a plant having the combined expression when compared to an appropriate control plant. For example, an increase in the level of RNAi in the plant, plant part or the plant cell can comprise at least about a 1%, about a 1%-5%, about a 5%-10%, about a 10%-20%, about a 20%-30%, about a 30%-40%, about a 40%-50%, about a 50%-60%, about 60-70%, about 70%-80%, about a 80%-90%, about a 90%-100% or greater increase in the level of RNAi in the plant, plant part, plant cell or phloem when compared to an appropriate control. In other embodiments, the increase in the level of RNAi in the plant, plant part, plant cell or phloem can comprise at least about a 1 fold, about a 1 fold-5 fold, about a 5 fold-10 fold, about a 10 fold-20 fold, about a 20 fold-30 fold, about a 30 fold-40 fold, about a 40 fold-50 fold, about a 50 fold-60 fold, about 60 fold-70 fold, about 70 fold-80 fold, about a 80 fold-90 fold, about a 90 fold-100 fold or greater increase in the level of RNAi in the plant, plant part, plant cell or phloem when compared to an appropriate control. Examples of combined expression of the silencing element with suppressor enhancer element for the control of Stinkbugs and *Lygus* can be found in U.S. Patent Application Publication 2011/0301223 and U.S. Patent Application Publication 2009/0192117.

Some embodiments relate to down-regulation of expression of target genes in insect pest species by interfering ribonucleic acid (RNA) molecules. PCT Publication WO 2007/074,405 describes methods of inhibiting expression of target genes in invertebrate pests including Colorado potato beetle. PCT Publication WO 2005/110,068 describes methods of inhibiting expression of target genes in invertebrate pests including in particular Western corn rootworm as a means to control insect infestation. Furthermore, PCT Publication WO 2009/091,864 describes compositions and methods for the suppression of target genes from insect pest species including pests from the *Lygus* genus. Nucleic acid molecules including RNAi for targeting the vacuolar ATPase H subunit, useful for controlling a coleopteran pest population and infestation as described in U.S. Patent Application Publication 2012/0198586. PCT Publication WO 2012/055, 982 describes ribonucleic acid (RNA or double stranded RNA) that inhibits or down regulates the expression of a target gene that encodes: an insect ribosomal protein such as the ribosomal protein L19, the ribosomal protein L40 or the ribosomal protein S27A; an insect proteasome subunit such as the Rpn6 protein, the Pros 25, the Rpn2 protein, the proteasome beta 1 subunit protein or the Pros beta 2 protein; an insect β-coatomer of the COPI vesicle, the γ-coatomer of the COPI vesicle, the β'-coatomer protein or the ζ-coatomer of the COPI vesicle; an insect Tetraspanine 2 A protein which is a putative transmembrane domain protein; an insect protein belonging to the actin family such as Actin 5C; an insect ubiquitin-5E protein; an insect Sec23 protein which is a GTPase activator involved in intracellular protein transport; an insect crinkled protein which is an unconventional myosin which is involved in motor activity; an insect crooked neck protein which is involved in the regulation of nuclear alternative mRNA splicing; an insect vacuolar H+-ATPase G-subunit protein and an insect Tbp-1 such as Tat-binding protein. US Patent Application Publications 2012/029750, U.S. 20120297501, and 2012/0322660 describe interfering ribonucleic acids (RNA or double stranded RNA) that functions upon uptake by an insect pest species to down-regulate expression of a target gene in said insect pest, wherein the RNA comprises at least one silencing element wherein the silencing element is a region of double-stranded RNA comprising annealed complementary strands, one strand of which comprises or consists of a sequence of nucleotides which is at least partially complementary to a target nucleotide sequence within the target gene. U.S. Patent Application Publication 2012/0164205 describe potential targets for interfering double stranded ribonucleic acids for inhibiting invertebrate pests including: a Chd3 Homologous Sequence, a Beta-Tubulin Homologous Sequence, a 40 kDa V-ATPase Homologous Sequence, a EF1α Homologous Sequence, a 26S Proteosome Subunit p28 Homologous Sequence, a Juvenile Hormone Epoxide Hydrolase Homologous Sequence, a Swelling Dependent Chloride Channel Protein Homologous Sequence, a Glucose-6-Phosphate 1-Dehydrogenase Protein Homologous Sequence, an Act42A Protein Homologous Sequence, a ADP-Ribosylation Factor 1 Homologous Sequence, a Transcription Factor IIB Protein Homologous Sequence, a Chitinase Homologous Sequences, a Ubiquitin Conjugating Enzyme Homologous Sequence, a Glyceraldehyde-3-Phosphate Dehydrogenase Homologous Sequence, an Ubiquitin B Homologous Sequence, a Juvenile Hormone Esterase Homolog, and an Alpha Tubulin Homologous Sequence.

Use in Pesticidal Control

General methods for employing strains comprising a nucleic acid sequence of the embodiments or a variant thereof, in pesticide control or in engineering other organisms as pesticidal agents are known in the art. See, for example U.S. Pat. No. 5,039,523 and EP 0480762A2.

Microorganism hosts that are known to occupy the "phytosphere" (phylloplane, phyllosphere, rhizosphere, and/or rhizoplane) of one or more crops of interest may be selected. These microorganisms are selected so as to be capable of successfully competing in the particular environment with the wild-type microorganisms, provide for stable maintenance and expression of the gene expressing the IPD079 polypeptide and desirably provide for improved protection of the pesticide from environmental degradation and inactivation.

Alternatively, the IPD079 polypeptides are produced by introducing a heterologous gene into a cellular host. Expression of the heterologous gene results, directly or indirectly, in the intracellular production and maintenance of the pesticide. These cells are then treated under conditions that prolong the activity of the toxin produced in the cell when the cell is applied to the environment of target pest(s). The resulting product retains the toxicity of the toxin. These naturally encapsulated IPD079 polypeptides may then be formulated in accordance with conventional techniques for application to the environment hosting a target pest, e.g., soil, water, and foliage of plants. See, for example EPA 0192319, and the references cited therein.

Pesticidal Compositions

In some embodiments the plant derived perforin can be applied in the form of compositions and can be applied to the crop area or plant to be treated, simultaneously or in succession, with other compounds. These compounds can be fertilizers, weed killers, Cryoprotectants, surfactants, detergents, pesticidal soaps, dormant oils, polymers, and/or time-release or biodegradable carrier formulations that permit long-term dosing of a target area following a single application of the formulation. They can also be selective herbicides, chemical insecticides, virucides, microbicides, amebicides, pesticides, fungicides, bactericides, nematicides, molluscicides or mixtures of several of these preparations, if desired, together with further agriculturally acceptable carriers, surfactants or application-promoting adjuvants customarily employed in the art of formulation. Suitable carriers and adjuvants can be solid or liquid and correspond to the substances ordinarily employed in formulation technology, e.g. natural or regenerated mineral substances, solvents, dispersants, wetting agents, tackifiers, binders or fertilizers. Likewise the formulations may be prepared into edible "baits" or fashioned into pest "traps" to permit feeding or ingestion by a target pest of the pesticidal formulation.

Methods of applying an active ingredient or an agrochemical composition that contains at least one of plant derived perforin of the disclosure including but not limited to the IPD079 polypeptide produced by the bacterial strains include leaf application, seed coating and soil application. The number of applications and the rate of application depend on the intensity of infestation by the corresponding pest.

The composition may be formulated as a powder, dust, pellet, granule, spray, emulsion, colloid, solution or such like, and may be prepared by such conventional means as desiccation, lyophilization, homogenation, extraction, filtration, centrifugation, sedimentation or concentration of a culture of cells comprising the polypeptide. In all such compositions that contain at least one such pesticidal polypeptide, the polypeptide may be present in a concentration of from about 1% to about 99% by weight. "About" with respect to % by weight means ±0.5%.

Lepidopteran, Dipteran, Heteropteran, nematode, Hemipteran or Coleopteran pests may be killed or reduced in numbers in a given area by the methods of the disclosure or may be prophylactically applied to an environmental area to prevent infestation by a susceptible pest. Preferably the pest ingests or is contacted with, a pesticidally-effective amount of the polypeptide. "Pesticidally-effective amount" as used herein refers to an amount of the pesticide that is able to bring about death to at least one pest or to noticeably reduce pest growth, feeding or normal physiological development. This amount will vary depending on such factors as, for example, the specific target pests to be controlled, the specific environment, location, plant, crop or agricultural site to be treated, the environmental conditions and the method, rate, concentration, stability, and quantity of application of the pesticidally-effective polypeptide composition. The formulations may also vary with respect to climatic conditions, environmental considerations, and/or frequency of application and/or severity of pest infestation.

The pesticide compositions described may be made by formulating the bacterial cell, Crystal and/or spore suspension or isolated protein component with the desired agriculturally-acceptable carrier. The compositions may be formulated prior to administration in an appropriate means such as lyophilized, freeze-dried, desiccated or in an aqueous carrier, medium or suitable diluent, such as saline or other buffer. The formulated compositions may be in the form of a dust or granular material or a suspension in oil (vegetable or mineral) or water or oil/water emulsions or as a wettable powder or in combination with any other carrier material suitable for agricultural application. Suitable agricultural carriers can be solid or liquid and are well known in the art. The term "agriculturally-acceptable carrier" covers all adjuvants, inert components, dispersants, surfactants, tackifiers, binders, etc. that are ordinarily used in pesticide formulation technology; these are well known to those skilled in pesticide formulation. The formulations may be mixed with one or more solid or liquid adjuvants and prepared by various means, e.g., by homogeneously mixing, blending and/or grinding the pesticidal composition with suitable adjuvants using conventional formulation techniques. Suitable formulations and application methods are described in U.S. Pat. No. 6,468,523, herein incorporated by reference. The seeds or plants can also be treated with one or more chemical compositions, including one or more herbicide, insecticides or fungicides. Exemplary chemical compositions include: Fruits/Vegetables Herbicides: Atrazine, Bromacil, Diuron, Glyphosate, Linuron, Metribuzin, Simazine, Trifluralin, Fluazifop, Glufosinate, Halo sulfuron Gowan, Paraquat, Propyzamide, Sethoxydim, Butafenacil, Halosulfuron, Indaziflam; Fruits/Vegetables Insecticides: Aldicarb, *Bacillus thuriengiensis*, Carbaryl, Carbofuran, Chlorpyrifos, Cypermethrin, Deltamethrin, Diazinon, Malathion, Abamectin, Cyfluthrin/beta-cyfluthrin, Esfenvalerate, Lambda-cyhalothrin, Acequinocyl, Bifenazate, Methoxyfenozide, Novaluron, Chromafenozide, Thiacloprid, Dinotefuran, FluaCrypyrim, Tolfenpyrad, Clothianidin, Spirodiclofen, Gamma-cyhalothrin, Spiromesifen, Spinosad, Rynaxypyr, Cyazypyr, Spinoteram, Triflumuron, Spirotetramat, Imidacloprid, Flubendiamide, Thiodicarb, Metaflumizone, Sulfoxaflor, Cyflumetofen, Cyanopyrafen, Imidacloprid, Clothianidin, Thiamethoxam, Spinotoram, Thiodicarb, Flonicamid, Methiocarb, Emamectin-benzoate, lndoxacarb, Forthiazate, Fenamiphos, Cadusaphos, Pyriproxifen, Fenbutatin-oxid, Hexthiazox, Methomyl, 4-[[(6-Chlorpyridin-3-yl)methyl](2,2-difluorethyl)amino]furan-2(5H)-on; Fruits/Vegetables Fungicides: Carbendazim, Chlorothalonil, EBDCs, Sulphur, Thiophanate-methyl, Azoxystrobin, Cymoxanil, Fluazinam, Fosetyl, Iprodione, Kresoxim-methyl, Metalaxyl/mefenoxam, Trifloxystrobin, Ethaboxam, Iprovalicarb, Trifloxystrobin, Fenhexamid, Oxpoconazole fumarate, Cyazofamid, Fenamidone, Zoxamide, Picoxystrobin, Pyraclostrobin, Cyflufenamid, Boscalid; Cereals Herbicides: Isoproturon, Bromoxynil, loxynil, Phenoxies, Chlorsulfuron, Clodinafop, Diclofop, Diflufenican, Fenoxaprop, Florasulam, Fluoroxypyr, Metsulfuron, Triasulfuron, Flucarbazone, Iodosulfuron, Propoxycarbazone, Picolinafen, Mesosulfuron, Beflubutamid, Pinoxaden, Amidosulfuron, Thifensulfuron Methyl, Tribenuron, Flupyrsulfuron, Sulfosulfuron, Pyrasulfotole, Pyroxsulam, Flufenacet, Tralkoxydim, Pyroxasulfon; Cereals Fungicides: Carbendazim, Chlorothalonil, Azoxystrobin, Cyproconazole, Cyprodinil, Fenpropimorph, Epoxiconazole, Kresoxim-methyl, Quinoxyfen, Tebuconazole, Trifloxystrobin, Simeconazole, Picoxystrobin, Pyraclostrobin, Dimoxystrobin, Prothioconazole, Fluoxastrobin; Cereals Insecticides: Dimethoate, Lambda-cyhalthrin, Deltamethrin, alpha-Cypermethrin, β-cyfluthrin, Bifenthrin, Imidacloprid, Clothianidin, Thiamethoxam, Thiacloprid, Acetamiprid, Dinitrofuran, Clorphyriphos, Methamidophos, Oxydemethon-methyl, Pirimicarb, Methiocarb; Maize Herbicides: Atrazine, Alachlor, Bromoxynil, Acetochlor, Dicamba, Clopyralid, (S—) Dimethenamid, Glufosinate, Glyphosate, Isoxaflutole, (S—)Metolachlore, Mesotrione, Nicosulfuron, Primisulfuron, Rimsulfuron, Sulcotrione, Foramsulfuron, Topramezone, Tembetarine, Saflufenacil, Thiencarbazone, Flufenacet, Pyroxasulfon; Maize Insecticides: Carbofuran, Chlorpyrifos, Bifenthrin, Fipronil, Imidacloprid, Lambda-Cyhalothrin, Tefluthrin, Terbufos, Thiamethoxam, Clothianidin, Spiromesifen, Flubendiamide, Triflumuron, Rynaxypyr, Deltamethrin, Thiodicarb, β-Cyfluthrin, Cypermethrin, Bifenthrin, Lufenuron, Triflumuron, Tefluthrin, Tebupirimphos, Ethiprole, Cyazypyr, Thiacloprid, Acetamiprid, Dinitrofuran, Avermectin, Methiocarb, Spirodiclofen, Spirotetramat; Maize Fungicides: Fenitropan, Thiram, Prothioconazole, Tebuconazole, Trifloxystrobin; Rice Herbicides: Butachlor, Propanyl, Azimsulfuron, Bensulfuron, Cyhalofop, Daimuron, Fentrazamide, Imazosulfuron, Mefenacet, Oxaziclomefone, Pyrazosulfuron, Pyributicarb, Quinclorac, Thiobencarb, Indanofan, Flufenacet, Fentrazamide, Halosulfuron, Oxaziclomefone, Benzobicyclon, Pyriftalid, Penoxsulam, Bispyribac, Oxadiargyl, Ethoxysulfuron, Pretilachlor, Mesotrione, Tefuryltrione, Oxadiazone, Fenoxaprop, Pyrimisulfan; Rice Insecticides: Diazinon, Fenitrothion, Fenobucarb, Monocrotophos, Benfuracarb, Buprofezin, Dinotefuran, Fipronil, Imidacloprid, Isoprocarb, Thiacloprid, Chromafenozide, Thiacloprid, Dinotefuran, Clothianidin, Ethiprole, Flubendiamide, Rynaxypyr, Deltamethrin, Acetamiprid, Thiamethoxam, Cyazypyr, Spinosad, Spinotoram, Emamectin-Benzoate, Cypermethrin, Chlorpyriphos, Cartap, Methamidophos, Etofenprox, Triazophos, 4-[[(6-Chlorpyridin-3-yl)methyl](2,2-difluorethyl)amino]furan-2(5H)-on, Carbofuran, Benfuracarb; Rice Fungicides: Thiophanate-methyl, Azoxystrobin, Carpropamid, Edifenphos, Ferimzone, Iprobenfos, Isoprothiolane, Pencycuron, Probenazole, Pyroquilon, Tricyclazole, Trifloxystrobin, Diclocymet, Fenoxanil, Simeconazole, Tiadinil; Cotton Herbicides: Diuron, Fluometuron, MSMA, Oxyfluorfen, Prometryn, Trifluralin, Carfentrazone, Clethodim, Fluazifop-butyl, Glyphosate, Norflurazon, Pendimethalin, Pyrithiobac-sodium, Trifloxysulfuron, Tepraloxydim, Glufosinate, Flumioxazin, Thidiazuron; Cotton Insecticides: Acephate, Aldicarb, Chlorpyrifos, Cypermethrin, Deltamethrin, Malathion, Monocrotophos, Abamectin, Acetamiprid, Emamectin Benzoate, Imidacloprid, Indoxacarb, Lambda-Cyhalothrin, Spinosad, Thiodicarb, Gamma-Cyhalothrin, Spiromesifen, Pyridalyl, Flonicamid, Flubendiamide, Triflumuron, Rynaxypyr, Beta-Cyfluthrin, Spirotetramat, Clothianidin, Thiamethoxam, Thiacloprid, Dinitrofuran, Flubendiamide, Cyazypyr, Spinosad, Spinotoram, gamma Cyhalothrin, 4-[[(6-Chlorpyridin-3-yl) methyl](2,2-difluorethyl)amino]furan-2(5H)-on, Thiodicarb, Avermectin, Flonicamid, Pyridalyl, Spiromesifen, Sulfoxaflor, Profenophos, Triazophos, Endosulfan; Cotton Fungicides: Etridiazole, Metalaxyl, Quintozene; Soybean Herbicides: Alachlor, Bentazone, Trifluralin, Chlorimuron-Ethyl, Cloransulam-Methyl, Fenoxaprop, Fomesafen, Fluazifop, Glyphosate, Imazamox, Imazaquin, Imazethapyr, (S—)Metolachlore, Metribuzin, Pendimethalin, Tepraloxydim, Glufosinate; Soybean Insecticides: Lambda-cyhalothrin, Methomyl, Parathion, Thiocarb, Imidacloprid, Clothianidin, Thiamethoxam, Thiacloprid, Acetamiprid, Dinitrofuran, Flubendiamide, Rynaxypyr, Cyazypyr, Spinosad, Spinotoram, Emamectin-Benzoate, Fipronil, Ethiprole, Deltamethrin, β-Cyfluthrin, gamma and lambda Cyhalothrin, 4-[[(6-Chlorpyridin-3-yl)methyl](2,2-difluorethyl)amino]furan-2(5H)-on, Spirotetramat, Spirodiclofen, Triflumuron, Flonicamid, Thiodicarb, beta-Cyfluthrin; Soybean Fungicides: Azoxystrobin, Cyproconazole, Epoxiconazole, Flutriafol, Pyraclostrobin, Tebuconazole, Trifloxystrobin, Prothioconazole, Tetraconazole; Sugarbeet Herbicides: Chloridazon, Desmedipham, Ethofumesate, Phenmedipham, Triallate, Clopyralid, Fluazifop, Lenacil, Metamitron, Quinmerac, Cycloxydim, Triflusulfuron, Tepraloxydim, Quizalofop; Sugarbeet Insecticides: Imidacloprid, Clothianidin, Thiamethoxam, Thiacloprid, Acetamiprid, Dinitrofuran, Deltamethrin, β-Cyfluthrin, gamma/lambda Cyhalothrin, 4-[[(6-Chlorpyridin-3-Amethyl](2,2-difluorethyl)amino]furan-2(5H)-on, Tefluthrin, Rynaxypyr, Cyaxypyr, Fipronil, Carbofuran; Canola Herbicides: Clopyralid, Diclofop, Fluazifop, Glufosinate, Glyphosate, Metazachlor, Trifluralin Ethametsulfuron, Quinmerac, Quizalofop, Clethodim, Tepraloxydim; Canola Fungicides: Azoxystrobin, Carbendazim, Fludioxonil, Iprodione, Prochloraz, Vinclozolin; Canola Insecticides: Carbofuran organophosphates, Pyrethroids, Thiacloprid, Deltamethrin, Imidacloprid, Clothianidin, Thiamethoxam, Acetamiprid, Dinitrofuran, β-Cyfluthrin, gamma and lambda Cyhalothrin, tau-Fluvaleriate, Ethiprole, Spinosad, Spinotoram, Flubendiamide, Rynaxypyr, Cyazypyr, 4-[[(6-Chlorpyridin-3-yl) methyl](2,2-difluorethyl)amino]furan-2(5H)-on.

In some embodiments the herbicide is Atrazine, Bromacil, Diuron, Chlorsulfuron, Metsulfuron, Thifensulfuron Methyl, Tribenuron, Acetochlor, Dicamba, Isoxaflutole, Nicosulfuron, Rimsulfuron, Pyrithiobac-sodium, Flumioxazin, Chlorimuron-Ethyl, Metribuzin, Quizalofop, S-metolachlore, Hexazine or combinations thereof.

In some embodiments the insecticide is Esfenvalerate, Chlorantraniliprole, Methomyl, Indoxacarb, Oxamyl or combinations thereof.

Pesticidal and Insecticidal Activity

"Pest" includes but is not limited to, insects, fungi, bacteria, nematodes, mites, ticks and the like. Insect pests include insects selected from the orders Coleoptera, Diptera, Hymenoptera, Lepidoptera, Mallophaga, Homoptera, Hemiptera Orthroptera, Thysanoptera, Dermaptera, Isoptera, Anoplura, Siphonaptera, Trichoptera, etc., particularly Lepidoptera and Coleoptera.

Those skilled in the art will recognize that not all compounds are equally effective against all pests. Compounds of the embodiments display activity against insect pests, which may include economically important agronomic, forest, greenhouse, nursery ornamentals, food and fiber, public and animal health, domestic and commercial structure, household and stored product pests.

Larvae of the order Lepidoptera include, but are not limited to, armyworms, cutworms, loopers and heliothines in the family Noctuidae *Spodoptera frugiperda* JE Smith (fall armyworm); *S. exigua* Hübner (beet armyworm); *S. litura* Fabricius (tobacco cutworm, cluster caterpillar); *Mamestra configurata* Walker (bertha armyworm); *M. brassicae* Linnaeus (cabbage moth); *Agrotis ipsilon* Hufnagel (black cutworm); *A. orthogonia* Morrison (western cutworm); *A. subterranea* Fabricius (granulate cutworm); *Alabama argillacea* Hübner (cotton leaf worm); *Trichoplusia ni* Hübner (cabbage looper); *Pseudoplusia includens* Walker (soybean looper); *Anticarsia gemmatalis* Hübner (velvetbean caterpillar); *Hypena scabra* Fabricius (green cloverworm); *Heliothis virescens* Fabricius (tobacco budworm); *Pseudaletia unipuncta* Haworth (armyworm); *Athetis mindara* Barnes and Mcdunnough (rough skinned cutworm); *Euxoa messoria* Harris (darksided cutworm); *Earias insulana* Boisduval (spiny bollworm); *E. vittella* Fabricius (spotted bollworm); *Helicoverpa armigera* Hübner (American bollworm); *H. zea* Boddie (corn earworm or cotton bollworm); *Melanchra picta* Harris (zebra caterpillar); *Egira (Xylomyges) curialis* Grote (citrus cutworm); borers, casebearers, webworms, coneworms, and skeletonizers from the family Pyralidae *Ostrinia nubilalis* Hübner (European corn borer); *Amyelois transitella* Walker (naval orangeworm); *Anagasta kuehniella* Zeller (Mediterranean flour moth); *Cadra cautella* Walker (almond moth); *Chilo suppressalis* Walker (rice stem borer); *C. partellus*, (sorghum borer); *Corcyra cephalonica* Stainton (rice moth); *Crambus caliginosellus* Clemens (corn root webworm); *C. teterrellus* Zincken (bluegrass webworm); *Cnaphalocrocis medinalis* Guenée (rice leaf roller); *Desmia funeralis* Hübner (grape leaffolder); *Diaphania hyalinata* Linnaeus (melon worm); *D. nitidalis* Stoll (pickleworm); *Diatraea grandiosella* Dyar (southwestern corn borer), *D. saccharalis* Fabricius (surgarcane borer); *Eoreuma loftini* Dyar (Mexican rice borer); *Ephestia elutella* Hübner (tobacco (cacao) moth); *Galleria mellonella* Linnaeus (greater wax moth); *Herpetogramma licarsisalis* Walker (sod webworm); *Homoeosoma electellum* Hulst (sunflower moth); *Elasmopalpus lignosellus* Zeller (lesser cornstalk borer); *Achroia grisella* Fabricius (lesser wax moth); *Loxostege sticticalis* Linnaeus (beet webworm); *Orthaga thyrisalis* Walker (tea tree web moth); *Maruca testulalis* Geyer (bean pod borer); *Plodia interpunctella* Hübner (Indian meal moth); *Scirpophaga incertulas* Walker (yellow stem borer); *Udea rubigalis* Guenée (celery leaftier); and leafrollers, budworms, seed worms and fruit worms in the family Tortricidae *Acleris gloverana* Walsingham (Western blackheaded budworm); *A. variana* Fernald (Eastern blackheaded budworm); *Archips argyrospila* Walker (fruit tree leaf roller); *A. rosana* Linnaeus (European leaf roller); and other *Archips* species, *Adoxophyes orana* Fischer von Rosslerstamm (summer fruit *tortrix* moth); *Cochylis hospes* Walsingham (banded sunflower moth); *Cydia latiferreana* Walsingham (filbertworm); *C. pomonella* Linnaeus (coding moth); *Platynota flavedana* Clemens (variegated leafroller); *P. stultana* Walsingham (omnivorous leafroller); *Lobesia botrana* Denis & Schiffermuller (European grape vine moth); *Spilonota ocellana* Denis & Schiffermuller (eyespotted bud moth); *Endopiza viteana* Clemens (grape berry moth); *Eupoecilia ambiguella* Hübner (vine moth); *Bonagota salubricola* Meyrick (Brazilian apple leafroller); *Grapholita molesta* Busck (oriental fruit moth); *Suleima helianthana* Riley (sunflower bud moth); *Argyrotaenia* spp.; *Choristoneura* spp.

Selected other agronomic pests in the order Lepidoptera include, but are not limited to, *Alsophila pometaria* Harris (fall cankerworm); *Anarsia lineatella* Zeller (peach twig borer); *Anisota senatoria* J. E. Smith (orange striped oakworm); *Antheraea pernyi* Guérin-Méneville (Chinese Oak Tussah Moth); *Bombyx mori* Linnaeus (Silkworm); *Bucculatrix thurberiella* Busck (cotton leaf perforator); *Collas* eurytheme Boisduval (alfalfa caterpillar); *Datana integerrima* Grote & Robinson (walnut caterpillar); *Dendrolimus sibiricus* Tschetwerikov (Siberian silk moth), *Ennomos subsignaria* Hübner (elm spanworm); *Erannis tiliaria* Harris (linden looper); *Euproctis chrysorrhoea* Linnaeus (browntail moth); *Harrisina americana* Guérin-Méneville (grapeleaf skeletonizer); *Hemileuca oliviae* Cockrell (range caterpillar); *Hyphantria cunea* Drury (fall webworm); *Keiferia lycopersicella* Walsingham (tomato pinworm); *Lambdina fiscellaria fiscellaria* Hulst (Eastern hemlock looper); *L. fiscellaria lugubrosa* Hulst (Western hemlock looper); *Leucoma salicis* Linnaeus (satin moth); *Lymantria dispar* Linnaeus (gypsy moth); *Manduca quinquemaculata* Haworth (five spotted hawk moth, tomato hornworm); *M. sexta* Haworth (tomato hornworm, tobacco hornworm); *Operophtera brumata* Linnaeus (winter moth); *Paleacrita vernata* Peck (spring cankerworm); *Papilio cresphontes* Cramer (giant swallowtail orange dog); *Phryganidia californica* Packard (California oakworm); *Phyllocnistis citrella* Stainton (citrus leafminer); *Phyllonorycter blancardella* Fabricius (spotted tentiform leafminer); *Pieris brassicae* Linnaeus (large white butterfly); *P. rapae* Linnaeus (small white butterfly); *P. napi* Linnaeus (green veined white butterfly); *Platyptilia carduidactyla* Riley (artichoke plume moth); *Plutella xylostella* Linnaeus (diamondback moth); *Pectinophora gossypiella* Saunders (pink bollworm); *Pontia protodice* Boisduval and Leconte (Southern cabbageworm); *Sabulodes aegrotata* Guenee (omnivorous looper); *Schizura concinna* J. E. Smith (red humped caterpillar); *Sitotroga cerealella* Olivier (Angoumois grain moth); *Thaumetopoea pityocampa* Schiffermuller (pine processionary caterpillar); *Tineola bisselliella* Hummel (webbing clothesmoth); *Tuta absoluta* Meyrick (tomato leafminer); *Yponomeuta padella* Linnaeus (ermine moth); *Heliothis subflexa* Guenee; *Malacosoma* spp. and *Orgyia* spp.

Of interest are larvae and adults of the order Coleoptera including weevils from the families Anthribidae, Bruchidae and Curculionidae (including, but not limited to: *Anthonomus grandis* Boheman (boll weevil); *Lissorhoptrus oryzophilus* Kuschel (rice water weevil); *Sitophilus granarius* Linnaeus (granary weevil); *S. oryzae* Linnaeus (rice weevil); *Hypera punctata* Fabricius (clover leaf weevil); *Cylindrocopturus adspersus* LeConte (sunflower stem weevil); *Smicronyx fulvus* LeConte (red sunflower seed weevil); *S. sordidus* LeConte (gray sunflower seed weevil); *Sphenophorus maidis* Chittenden (maize billbug)); flea beetles, cucumber beetles, rootworms, leaf beetles, potato beetles and leafminers in the family Chrysomelidae (including, but not limited to: *Leptinotarsa decemlineata* Say (Colorado potato beetle); *Diabrotica virgifera virgifera* LeConte (western corn rootworm); *D. barberi* Smith and Lawrence (northern corn rootworm); *D. undecimpunctata howardi* Barber (southern corn rootworm); *Chaetocnema pulicaria* Melsheimer (corn flea beetle); *Phyllotreta cruciferae* Goeze (Crucifer flea beetle); *Phyllotreta striolata* (stripped flea beetle); *Colaspis brunnea* Fabricius (grape *colaspis*); *Oulema melanopus* Linnaeus (cereal leaf beetle); *Zygogramma exclamationis* Fabricius (sunflower beetle)); beetles from the family Coccinellidae (including, but not limited to: *Epilachna varivestis* Mulsant (Mexican bean beetle)); chafers and other beetles from the family Scarabaeidae (including, but not limited to: *Popillia japonica* Newman (Japanese beetle); *Cyclocephala borealis* Arrow (northern masked chafer, white grub); *C. immaculata* Olivier (southern masked chafer, white grub); *Rhizotrogus majalis* Razoumowsky (European chafer); *Phyllophaga crinita* Burmeister (white grub); *Ligyrus gibbosus* De Geer (carrot beetle)); carpet beetles from the family Dermestidae; wireworms from the family Elateridae, *Eleodes* spp., *Melanotus* spp.; *Conoderus* spp.; *Limonius* spp.; *Agriotes* spp.; *Ctenicera* spp.; *Aeolus* spp.; bark beetles from the family Scolytidae and beetles from the family Tenebrionidae.

Adults and immatures of the order Diptera are of interest, including leafminers *Agromyza parvicornis* Loew (corn blotch leafminer); midges (including, but not limited to: *Contarinia sorghicola* Coquillett (sorghum midge); *Mayetiola destructor* Say (Hessian fly); *Sitodiplosis mosellana* Géhin (wheat midge); *Neolasioptera murtfeldtiana* Felt, (sunflower seed midge)); fruit flies (Tephritidae), *Oscinella frit* Linnaeus (fruit flies); maggots (including, but not limited to: *Delia platura* Meigen (seedcorn maggot); *D. coarctata* Fallen (wheat bulb fly) and other *Delia* spp., *Meromyza americana* Fitch (wheat stem maggot); *Musca domestica* Linnaeus (house flies); *Fannia canicularis* Linnaeus, *F. femoralis* Stein (lesser house flies); *Stomoxys calcitrans* Linnaeus (stable flies)); face flies, horn flies, blow flies, *Chrysomya* spp.; *Phormia* spp. and other muscoid fly pests, horse flies *Tabanus* spp.; bot flies *Gastrophilus* spp.; *Oestrus* spp.; cattle grubs *Hypoderma* spp.; deer flies *Chrysops* spp.; *Melophagus ovinus* Linnaeus (keds) and other *Brachycera*, mosquitoes *Aedes* spp.; *Anopheles* spp.; *Culex* spp.; black flies *Prosimulium* spp.; *Simulium* spp.; biting midges, sand flies, sciarids, and other *Nematocera*.

Included as insects of interest are adults and nymphs of the orders Hemiptera and Homoptera such as, but not limited to, adelgids from the family Adelgidae, plant bugs from the family Miridae, cicadas from the family Cicadidae, leafhoppers, *Empoasca* spp.; from the family Cicadellidae, planthoppers from the families Cixiidae, Flatidae, Fulgoroidea, Issidae and Delphacidae, treehoppers from the family Membracidae, psyllids from the family Psyllidae, whiteflies from the family Aleyrodidae, aphids from the family Aphididae, phylloxera from the family Phylloxeridae, mealybugs from the family Pseudococcidae, scales from the families Asterolecanidae, Coccidae, Dactylopiidae, Diaspididae, Eriococcidae Ortheziidae, Phoenicococcidae and Margarodidae, lace bugs from the family Tingidae, stink bugs from the family Pentatomidae, cinch bugs, *Blissus* spp.; and other seed bugs from the family Lygaeidae, spittlebugs from the family Cercopidae squash bugs from the family Coreidae and red bugs and cotton stainers from the family Pyrrhocoridae.

Agronomically important members from the order Homoptera further include, but are not limited to: *Acyrthisiphon pisum* Harris (pea aphid); *Aphis craccivora* Koch (cowpea aphid); *A. fabae* Scopoli (black bean aphid); *A. gossypii* Glover (cotton aphid, melon aphid); *A. maidiradicis* Forbes (corn root aphid); *A. pomi* De Geer (apple aphid); *A. spiraecola* Patch (spirea aphid); *Aulacorthum solani* Kaltenbach (foxglove aphid); *Chaetosiphon fragaefolii* Cockerell (strawberry aphid); *Diuraphis noxia* Kurdjumov/ Mordvilko (Russian wheat aphid); *Dysaphis plantaginea* Paaserini (rosy apple aphid); *Eriosoma lanigerum* Hausmann (woolly apple aphid); *Brevicoryne brassicae* Linnaeus (cabbage aphid); *Hyalopterus pruni* Geoffroy (mealy plum aphid); *Lipaphis erysimi* Kaltenbach (turnip aphid); *Metopolophium dirrhodum* Walker (cereal aphid); *Macrosiphum euphorbiae* Thomas (potato aphid); *Myzus persicae* Sulzer (peach-potato aphid, green peach aphid); *Nasonovia ribisnigri* Mosley (lettuce aphid); *Pemphigus* spp. (root aphids and gall aphids); *Rhopalosiphum maidis* Fitch (corn leaf aphid); *R. padi* Linnaeus (bird cherry-oat aphid); *Schizaphis graminum* Rondani (greenbug); *Sipha flava* Forbes (yellow sugarcane aphid); *Sitobion avenae* Fabricius (English grain aphid); *Therioaphis maculata* Buckton (spotted alfalfa aphid); *Toxoptera aurantii* Boyer de Fonscolombe (black citrus aphid) and *T. citricida* Kirkaldy (brown citrus aphid); *Adelges* spp. (adelgids); *Phylloxera devastatrix* Pergande (pecan *phylloxera*); *Bemisia tabaci* Gennadius (tobacco whitefly, sweetpotato whitefly); *B. argentifolii* Bellows & Perring (silverleaf whitefly); *Dialeurodes citri* Ashmead (citrus whitefly); *Trialeurodes abutiloneus* (bandedwinged whitefly) and *T. vaporariorum* Westwood (greenhouse whitefly); *Empoasca fabae* Harris (potato leafhopper); *Laodelphax striatellus* Fallen (smaller brown planthopper); *Macrolestes quadrilineatus* Forbes (aster leafhopper); *Nephotettix cinticeps* Uhler (green leafhopper); *N. nigropictus* Stål (rice leafhopper); *Nilaparvata lugens* Stål (brown planthopper); *Peregrinus maidis* Ashmead (corn planthopper); *Sogatella furcifera* Horvath (white-backed planthopper); *Sogatodes orizicola* Muir (rice delphacid); *Typhlocyba pomaria* McAtee (white apple leafhopper); *Erythroneoura* spp. (grape leafhoppers); *Magicicada septendecim* Linnaeus (periodical cicada); *Icerya purchasi* Maskell (cottony cushion scale); *Quadraspidiotus perniciosus* Comstock (San Jose scale); *Planococcus citri* Risso (citrus mealybug); *Pseudococcus* spp. (other mealybug complex); *Cacopsylla pyricola* Foerster (pear psylla); *Trioza diospyri* Ashmead (persimmon psylla).

Agronomically important species of interest from the order Hemiptera include, but are not limited to: *Acrosternum hilare* Say (green stink bug); *Anasa tristis* De Geer (squash bug); *Blissus leucopterus leucopterus* Say (chinch bug); *Corythuca gossypii* Fabricius (cotton lace bug); *Cyrtopeltis modesta* Distant (tomato bug); *Dysdercus suturellus* Herrich-Schaffer (cotton stainer); *Euschistus servus* Say (brown stink bug); *E. variolarius* Palisot de Beauvois (one-spotted stink bug); *Graptostethus* spp. (complex of seed bugs); *Leptoglossus corculus* Say (leaf-footed pine seed bug); *Lygus lineolaris* Palisot de Beauvois (tarnished plant bug); *L. Hesperus* Knight (Western tarnished plant bug); *L. pratensis* Linnaeus (common meadow bug); *L. rugulipennis* Poppius (European tarnished plant bug); *Lygocoris pabulinus* Linnaeus (common green capsid); *Nezara viridula* Linnaeus (southern green stink bug); *Oebalus pugnax* Fabricius (rice stink bug); *Oncopeltus fasciatus* Dallas (large milkweed bug); *Pseudatomoscelis seriatus* Reuter (cotton fleahopper).

Furthermore, embodiments may be effective against Hemiptera such, *Calocoris norvegicus* Gmelin (strawberry bug); *Orthops campestris* Linnaeus; *Plesiocoris rugicollis* Fallen (apple capsid); *Cyrtopeltis modestus* Distant (tomato bug); *Cyrtopeltis notatus* Distant (suckfly); *Spanagonicus albofasciatus* Reuter (whitemarked fleahopper); *Diaphnocoris chlorionis* Say (honeylocust plant bug); *Labopidicola allii* Knight (onion plant bug); *Pseudatomoscelis seriatus* Reuter (cotton fleahopper); *Adelphocoris rapidus* Say (rapid plant bug); *Poecilocapsus lineatus* Fabricius (four-lined plant bug); *Nysius ericae* Schilling (false chinch bug); *Nysius raphanus* Howard (false chinch bug); *Nezara viridula* Linnaeus (Southern green stink bug); *Eurygaster* spp.; *Coreidae* spp.; *Pyrrhocoridae* spp.; *Tinidae* spp.; *Blostomatidae* spp.; *Reduviidae* spp. and *Cimicidae* spp.

Also included are adults and larvae of the order Acari (mites) such as *Aceria tosichella* Keifer (wheat curl mite); *Petrobia latens* Müller (brown wheat mite); spider mites and red mites in the family Tetranychidae, *Panonychus ulmi* Koch (European red mite); *Tetranychus urticae* Koch (two spotted spider mite); (*T. mcdanieli* McGregor (McDaniel mite); *T. cinnabarinus* Boisduval (carmine spider mite); *T. turkestani* Ugarov & Nikolski (strawberry spider mite); flat mites in the family Tenuipalpidae, *Brevipalpus lewisi* McGregor (citrus flat mite); rust and bud mites in the family Eriophyidae and other foliar feeding mites and mites important in human and animal health, i.e., dust mites in the family Epidermoptidae, follicle mites in the family Demodicidae, grain mites in the family Glycyphagidae, ticks in the order Ixodidae. *Ixodes scapularis* Say (deer tick); *I. holocyclus* Neumann (Australian paralysis tick); *Dermacentor variabilis* Say (American dog tick); *Amblyomma americanum* Linnaeus (lone star tick) and scab and itch mites in the families Psoroptidae, Pyemotidae and Sarcoptidae.

Insect pests of the order Thysanura are of interest, such as *Lepisma saccharina* Linnaeus (silverfish); *Thermobia domestica* Packard (firebrat).

Additional arthropod pests covered include: spiders in the order Araneae such as *Loxosceles reclusa* Gertsch and Mulaik (brown recluse spider) and the *Latrodectus mactans* Fabricius (black widow spider) and centipedes in the order Scutigeromorpha such as *Scutigera coleoptrata* Linnaeus (house centipede).

Insect pest of interest include the superfamily of stink bugs and other related insects including but not limited to species belonging to the family Pentatomidae (*Nezara viridula, Halyomorpha halys, Piezodorus guildini, Euschistus servus, Acrosternum hilare, Euschistus heros, Euschistus tristigmus, Acrosternum hilare, Dichelops furcatus, Dichelops melacanthus*, and *Bagrada hilaris* (Bagrada Bug)), the family Plataspidae (*Megacopta cribraria*—Bean plataspid) and the family Cydnidae (*Scaptocoris castanea*—Root stink bug) and Lepidoptera species including but not limited to: diamond-back moth, e.g., *Helicoverpa zea* Boddie; soybean looper, e.g., *Pseudoplusia includens* Walker and velvet bean caterpillar e.g., *Anticarsia gemmatalis* Hübner.

Methods for measuring pesticidal activity are well known in the art. See, for example, Czapla and Lang, (1990) *J. Econ. Entomol.* 83:2480-2485; Andrews, et al., (1988) *Biochem. J.* 252:199-206; Marrone, et al., (1985) *J. of Economic Entomology* 78:290-293 and U.S. Pat. No. 5,743,477, all of which are herein incorporated by reference in their entirety. Generally, the protein is mixed and used in feeding assays. See, for example Marrone, et al., (1985) *J. of Economic Entomology* 78:290-293. Such assays can include contacting plants with one or more pests and determining the plant's ability to survive and/or cause the death of the pests.

Nematodes include parasitic nematodes such as root-knot, cyst and lesion nematodes, including *Heterodera* spp., *Meloidogyne* spp. and *Globodera* spp.; particularly members of the cyst nematodes, including, but not limited to, *Heterodera glycines* (soybean cyst nematode); *Heterodera schachtii* (beet cyst nematode); *Heterodera avenae* (cereal cyst nematode) and *Globodera rostochiensis* and *Globodera pailida* (potato cyst nematodes). Lesion nematodes include *Pratylenchus* spp.

Seed Treatment

To protect and to enhance yield production and trait technologies, seed treatment options can provide additional crop plan flexibility and cost effective control against insects, weeds and diseases. Seed material can be treated, typically surface treated, with a composition comprising combinations of chemical or biological herbicides, herbicide safeners, insecticides, fungicides, germination inhibitors and enhancers, nutrients, plant growth regulators and activators, bactericides, nematicides, avicides and/or molluscicides. These compounds are typically formulated together with further carriers, surfactants or application-promoting adjuvants customarily employed in the art of formulation. The coatings may be applied by impregnating propagation material with a liquid formulation or by coating with a combined wet or dry formulation. Examples of the various types of compounds that may be used as seed treatments are provided in The Pesticide Manual: A World Compendium, C. D. S. Tomlin Ed., Published by the British Crop Production Council, which is hereby incorporated by reference.

Some seed treatments that may be used on crop seed include, but are not limited to, one or more of abscisic acid, acibenzolar-S-methyl, avermectin, amitrole, azaconazole, azospirillum, azadirachtin, azoxystrobin, *Bacillus* spp. (including one or more of *cereus, firmus, megaterium, pumilis, sphaericus, subtilis* and/or *thuringiensis* species), *Bradyrhizobium* spp. (including one or more of *betae, canariense, elkanii, iriomotense, japonicum, liaonigense, pachyrhizi* and/or *yuanmingense*), captan, carboxin, chitosan, clothianidin, copper, cyazypyr, difenoconazole, etridiazole, fipronil, fludioxonil, fluoxastrobin, fluquinconazole, flurazole, fluxofenim, harpin protein, imazalil, imidacloprid, ipconazole, isoflavonoids, lipo-chitooligosaccharide, mancozeb, manganese, maneb, mefenoxam, metalaxyl, metconazole, myclobutanil, PCNB, penflufen, penicillium, penthiopyrad, permethrine, picoxystrobin, prothioconazole, pyraclostrobin, rynaxypyr, S-metolachlore, saponin, sedaxane, TCMTB, tebuconazole, thiabendazole, thiamethoxam, thiocarb, thiram, tolclofos-methyl, triadimenol, trichoderma, trifloxystrobin, triticonazole and/or zinc. PCNB seed coat refers to EPA Registration Number 00293500419, containing quintozene and terrazole. TCMTB refers to 2-(thiocyanomethylthio) benzothiazole.

Seed varieties and seeds with specific transgenic traits may be tested to determine which seed treatment options and application rates may complement such varieties and transgenic traits in order to enhance yield. For example, a variety with good yield potential but head smut susceptibility may benefit from the use of a seed treatment that provides protection against head smut, a variety with good yield potential but cyst nematode susceptibility may benefit from the use of a seed treatment that provides protection against cyst nematode, and so on. Likewise, a variety encompassing a transgenic trait conferring insect resistance may benefit from the second mode of action conferred by the seed treatment, a variety encompassing a transgenic trait conferring herbicide resistance may benefit from a seed treatment with a safener that enhances the plants resistance to that herbicide, etc. Further, the good root establishment and early emergence that results from the proper use of a seed treatment may result in more efficient nitrogen use, a better ability to withstand drought and an overall increase in yield potential of a variety or varieties containing a certain trait when combined with a seed treatment.

Methods for Killing an Insect Pest and Controlling an Insect Population

In some embodiments methods are provided for killing an insect pest, comprising contacting the insect pest with an insecticidally-effective amount of at least one recombinant plant derived perforin including but not limited to a IPD079 polypeptide. In some embodiments methods are provided for killing an insect pest, comprising contacting the insect pest with an insecticidally-effective amount of a recombinant pesticidal protein of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, or SEQ ID NO: 140 or a variant thereof.

In some embodiments methods are provided for controlling an insect pest population, comprising contacting the insect pest population with an insecticidally-effective amount of a recombinant IPD079 polypeptide. In some embodiments methods are provided for controlling an insect pest population, comprising contacting the insect pest population with an insecticidally-effective amount of a recombinant IPD079 polypeptide of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, or SEQ ID NO: 140 or a variant thereof. As used herein, "controlling a pest population" or "controls a pest" refers to any effect on a pest that results in limiting the damage that the pest causes. Controlling a pest includes, but is not limited to, killing the pest, inhibiting development of the pest, altering fertility or growth of the pest in such a manner that the pest provides less damage to the plant, decreasing the number of offspring produced, producing less fit pests, producing pests more susceptible to predator attack or deterring the pests from eating the plant.

In some embodiments methods are provided for controlling an insect pest population resistant to a pesticidal protein, comprising contacting the insect pest population with an insecticidally-effective amount of a recombinant IPD079 polypeptide. In some embodiments methods are provided for controlling an insect pest population resistant to a pesticidal protein, comprising contacting the insect pest population with an insecticidally-effective amount of a recombinant IPD079 polypeptide SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, or SEQ ID NO: 140 or a variant thereof.

In some embodiments methods are provided for protecting a plant from an insect pest, comprising expressing in the plant or cell thereof at least one heterologous recombinant polynucleotide encoding an IPD079 polypeptide. In some embodiments methods are provided for protecting a plant from an insect pest, comprising expressing in the plant or cell thereof a recombinant polynucleotide encoding IPD079 polypeptide of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, or SEQ ID NO: 140 or variants thereof.

In some embodiments methods are provided for protecting a plant from an insect pest, comprising expressing in the plant or cell thereof at least one recombinant polynucleotide encoding a heterologous plant derived perforin. In some embodiments methods are provided for protecting a plant from an insect pest, comprising expressing in the plant or cell thereof at least one recombinant polynucleotide encoding an IPD094 polypeptide.

In some embodiments methods are provided for protecting a plant from an insect pest, comprising expressing in the plant or cell thereof at least one recombinant polynucleotide encoding the IPD094Aa polypeptide of SEQ ID NO: 144 or a homolog or variant thereof. In some embodiments methods are provided for protecting a plant from an insect pest, comprising expressing in the plant or cell thereof at least one recombinant polynucleotide encoding a heterologous plant derived perforin. In some embodiments methods are provided for protecting a plant from an insect pest, comprising expressing in the plant or cell thereof at least one recombinant polynucleotide encoding a heterologous plant derived perforin of any one of SEQ ID NOs: 158-1248 or a homolog or variant thereof.

Insect Resistance Management (IRM) Strategies

Expression of *B. thuringiensis* δ-endotoxins in transgenic corn plants has proven to be an effective means of controlling agriculturally important insect pests (Perlak, et al., 1990; 1993). However, insects have evolved that are resistant to *B. thuringiensis* δ-endotoxins expressed in transgenic plants. Such resistance, should it become widespread, would clearly limit the commercial value of germplasm containing genes encoding such *B. thuringiensis* δ-endotoxins.

One way to increasing the effectiveness of the transgenic insecticides against target pests and contemporaneously reducing the development of insecticide-resistant pests is to use provide non-transgenic (i.e., non-insecticidal protein) refuges (a section of non-insecticidal crops/corn) for use with transgenic crops producing a single insecticidal protein active against target pests. The United States Environmental Protection Agency (epa.gov/oppbppdl/biopesticides/pips/bt_corn_refuge_2006.htm, which can be accessed using the www prefix) publishes the requirements for use with transgenic crops producing a single Bt protein active against target pests. In addition, the National Corn Growers Association, on their website: (ncga.com/insect-resistance-management-fact-sheet-bt-corn, which can be accessed using the www prefix) also provides similar guidance regarding refuge requirements. Due to losses to insects within the refuge area, larger refuges may reduce overall yield.

Another way of increasing the effectiveness of the transgenic insecticides against target pests and contemporaneously reducing the development of insecticide-resistant pests would be to have a repository of insecticidal genes that are effective against groups of insect pests and which manifest their effects through different modes of action.

Expression in a plant of two or more insecticidal compositions toxic to the same insect species, each insecticide being expressed at efficacious levels would be another way to achieve control of the development of resistance. This is based on the principle that evolution of resistance against two separate modes of action is far more unlikely than only one. Roush, for example, outlines two-toxin strategies, also called "pyramiding" or "stacking," for management of insecticidal transgenic crops. (The Royal Society. Phil. Trans. R. Soc. Lond. B. (1998) 353:1777-1786). Stacking or pyramiding of two different proteins each effective against the target pests and with little or no cross-resistance can allow for use of a smaller refuge. The U.S. Environmental Protection Agency requires significantly less (generally 5%) structured refuge of non-Bt corn be planted than for single trait products (generally 20%). There are various ways of providing the IRM effects of a refuge, including various geometric planting patterns in the fields and in-bag seed mixtures, as discussed further by Roush.

In some embodiments the plant derived perforin of the disclosure including but not limited to an IPD079 polypeptide are useful as an insect resistance management strategy in combination (i.e., pyramided) with other pesticidal proteins include but are not limited to Bt toxins, *Xenorhabdus* sp. or *Photorhabdus* sp. insecticidal proteins, and the like.

Provided are methods of controlling Lepidoptera and/or Coleoptera insect infestation(s) in a transgenic plant that promote insect resistance management, comprising expressing in the plant at least two different insecticidal proteins having different modes of action.

In some embodiments the methods of controlling Lepidoptera and/or Coleoptera insect infestation in a transgenic plant and promoting insect resistance management the at least one of the insecticidal proteins comprise an IPD094 polypeptide insecticidal to insects in the order Lepidoptera and/or Coleoptera.

In some embodiments the methods of controlling Lepidoptera and/or Coleoptera insect infestation in a transgenic plant and promoting insect resistance management the at least one of the insecticidal proteins comprise a plant derived perforin insecticidal to insects in the order Lepidoptera and/or Coleoptera.

In some embodiments the methods of controlling Lepidoptera and/or Coleoptera insect infestation in a transgenic plant and promoting insect resistance management the at least one of the insecticidal proteins comprise an IPD079 polypeptide insecticidal to insects in the order Lepidoptera and/or Coleoptera.

In some embodiments the methods of controlling Lepidoptera and/or Coleoptera insect infestation in a transgenic plant and promoting insect resistance management the at least one of the insecticidal proteins comprises an IPD079 polypeptide of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, or SEQ ID NO: 140 or variants thereof, insecticidal to insects in the order Lepidoptera and/or Coleoptera.

In some embodiments the methods of controlling Lepidoptera and/or Coleoptera insect infestation in a transgenic plant and promoting insect resistance management comprise expressing in the transgenic plant an IPD079 polypeptide and a Cry protein insecticidal to insects in the order Lepidoptera and/or Coleoptera having different modes of action.

In some embodiments the methods of controlling Lepidoptera and/or Coleoptera insect infestation in a transgenic plant and promoting insect resistance management comprise in the transgenic plant an IPD079 polypeptide of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, or SEQ ID NO: 140 or variants thereof and a Cry protein insecticidal to insects in the order Lepidoptera and/or Coleoptera, having different modes of action.

Also provided are methods of reducing likelihood of emergence of Lepidoptera and/or Coleoptera insect resistance to transgenic plants expressing in the plants insecticidal proteins to control the insect species, comprising expression of an IPD079 polypeptide insecticidal to the insect species in combination with a second insecticidal protein to the insect species having different modes of action.

Also provided are means for effective Lepidoptera and/or Coleoptera insect resistance management of transgenic plants, comprising co-expressing at high levels in the plants two or more insecticidal proteins toxic to Lepidoptera and/or Coleoptera insects but each exhibiting a different mode of effectuating its killing activity, wherein the two or more insecticidal proteins comprise an IPD079 polypeptide and a Cry protein. Also provided are means for effective Lepidoptera and/or Coleoptera insect resistance management of transgenic plants, comprising co-expressing at high levels in the plants two or more insecticidal proteins toxic to Lepidoptera and/or Coleoptera insects but each exhibiting a different mode of effectuating its killing activity, wherein the two or more insecticidal proteins comprise an IPD079 polypeptide of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, or SEQ ID NO: 140 or variants thereof and a Cry protein.

In addition, methods are provided for obtaining regulatory approval for planting or commercialization of plants expressing proteins insecticidal to insects in the order Lepidoptera and/or Coleoptera, comprising the step of referring to, submitting or relying on insect assay binding data showing that the IPD079 polypeptide does not compete with binding sites for Cry proteins in such insects. In addition, methods are provided for obtaining regulatory approval for planting or commercialization of plants expressing proteins insecticidal to insects in the order Lepidoptera and/or Coleoptera, comprising the step of referring to, submitting or relying on insect assay binding data showing that the IPD079 polypeptide of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, or SEQ ID NO: 140 or variant thereof does not compete with binding sites for Cry proteins in such insects.

Methods for Increasing Plant Yield

Methods for increasing plant yield are provided. The methods comprise providing a plant or plant cell expressing a polynucleotide encoding the pesticidal polypeptide sequence disclosed herein and growing the plant or a seed thereof in a field infested with a pest against which the polypeptide has pesticidal activity. In some embodiments, the polypeptide has pesticidal activity against a Lepidopteran, Coleopteran, Dipteran, Hemipteran or nematode pest, and the field is infested with a Lepidopteran, Hemipteran, Coleopteran, Dipteran or nematode pest.

As defined herein, the "yield" of the plant refers to the quality and/or quantity of biomass produced by the plant. "Biomass" as used herein refers to any measured plant product. An increase in biomass production is any improvement in the yield of the measured plant product. Increasing plant yield has several commercial applications. For example, increasing plant leaf biomass may increase the yield of leafy vegetables for human or animal consumption. Additionally, increasing leaf biomass can be used to increase production of plant-derived pharmaceutical or industrial products. An increase in yield can comprise any statistically significant increase including, but not limited to, at least a 1% increase, at least a 3% increase, at least a 5% increase, at least a 10% increase, at least a 20% increase, at least a 30%, at least a 50%, at least a 70%, at least a 100% or a greater increase in yield compared to a plant not expressing the pesticidal sequence.

In specific methods, plant yield is increased as a result of improved pest resistance of a plant expressing an IPD079 polypeptide disclosed herein. Expression of the IPD079 polypeptide results in a reduced ability of a pest to infest or feed on the plant, thus improving plant yield.

Methods of Processing

Further provided are methods of processing a plant, plant part or seed to obtain a food or feed product from a plant, plant part or seed comprising a plant derived perforin or an IPD079 polypeptide. The plants, plant parts or seeds provided herein, can be processed to yield oil, protein products and/or by-products that are derivatives obtained by processing that have commercial value. Non-limiting examples include transgenic seeds comprising a nucleic acid molecule encoding an IPD079 polypeptide which can be processed to yield soy oil, soy products and/or soy by-products.

"Processing" refers to any physical and chemical methods used to obtain any soy product and includes, but is not limited to, heat conditioning, flaking and grinding, extrusion, solvent extraction or aqueous soaking and extraction of whole or partial seeds The following examples are offered by way of illustration and not by way of limitation.

EXPERIMENTALS

Example 1—Identification of the Insecticidal Protein IPD079Aa Active Against *Diabrotica* Species from *Huperzia phlegmaria*

The insecticidal protein IPD079Aa (SEQ ID NO: 2) was identified by protein purification, mass spectrometry (MS) and PCR cloning from *Huperzia phlegmaria* (L.) Rothm., (Id. #PS-8582) as follows. A sample of *Huperzia phlegmaria* (L.) Rothm. (Id. #PS-8582) was collected, flash frozen in liquid $N_2$ and stored at −80° C. After storage it was ground to a fine powder at liquid $N_2$ temperatures with a Geno/Grinder® Ball Mill (SPEX Sample Prep LLC, Metuchen, N.J.). To extract protein, 20 ml of 50 mM Tris buffer, pH 8.0, 150 mM KCl, 2.5 mM EDTA, 1.5% polyvinylpolypyrrolidone (PVPP) and protease inhibitor cocktail (Roche Diagnostics, Germany) was added to every 5 grams of fresh weight of tissue. The homogenate was centrifuged to remove cell debris, filtered through 0.22 μm filters and desalted using 10 ml Zeba™ Spin Desalting columns (Thermo Scientific, IL.).

In-vitro bioassays against Western corn root worm (WCRW) (*Diabrotica virgifera virgifera*) were conducted using the desalted protein extract overlaid onto an agar-based Coleoptera diet (Southland Products Inc., Lake Village, Ark.) in a 96-well plate format. Three replicates were used per sample. Samples were allowed to dry on top of the diet and five to eight neonate insects were placed into each well of the treated plate. After 48 hours of incubation at 27° C., larvae were scored for mortality or severity of stunting. The scores were recorded numerically as dead (3), severely stunted (2) (little or no growth but alive and equivalent to a 1st instar larvae), stunted (1) (growth to second instar but not equivalent to controls), or normal (0). Subjecting the sample to proteinase K and heat treatments resulted in loss of activity indicating that the sample was proteinaceous in nature. Bioassay results are shown in Table 1.

TABLE 1

| Activity of *H. phlegmaria* Protein Extract Against Western Corn Root Work Larvae | |
|---|---|
| Average Score of Desalted material | Average score after proteinase K/Heat Treatment |
| 2 | 0 |

Example 2—Purification of the IPD079Aa Homologs

The protein purification scheme used is as follows, 50 g of PS-8582 plant material was ground, the protein fraction extracted, and desalted as described in Example 1. The desalted material was applied to a 5 ml GE HiTrap™ SP column (GE, Piscataway, N.J.) and was eluted with a linear 30 column volume gradient from 0 to 0.35M NaCl in 50 mM MES, pH 6.0, in 1.5 ml fractions. The SP flow through was identified as WCRW active through in-vitro bioassay (as described above). The flow through fraction was concentrated using Amicon® molecular weight cutoff filtration (Millipore, Billerica, Mass.) for 3 kD. The ~3.2× concentrated retentate was brought up to 30% $(NH_4)_2SO_4$. The 30% $(NH_4)_2SO_4$ solution was centrifuged to remove any precipitate and applied to a 1 ml GE HiTrap™ Butyl HIC column (GE, Piscataway, N.J.) and eluted with a linear 50 column volume gradient from 1 to 0M $(NH_4)_2SO_4$ in 50 mM MES, pH 6.0, in 1.0 ml fractions. Fractions were desalted with 0.5 ml Zeba™ desalting columns (Thermo Scientific, IL.) to remove $(NH_4)_2SO_4$. Active WCRW fractions were identified as active through in-vitro bioassay (as described above). SDS-PAGE of the active fractions contained a Coomassie® stained band at ~55 kD which was excised and tryptic digested.

Protein sequencing and identification was performed by Mass Spectrometry (MS) analysis after protein digestion with trypsin. Proteins for MS identification were obtained after running the sample on an LDS-PAGE gel stained with Coomassie® Brilliant Blue G-250. The two bands of interest were excised from the gel, de-stained, reduced with dithiothreitol and then alkylated with iodoacetamide. Following overnight digestion with trypsin, the samples were submitted for Liquid chromatography-mass spectrometry (LC-MS) analysis. Liquid chromatography-tandem mass spectrometry (LC-MS/MS) analysis for tryptically-digested peptides was conducted using electrospray on a QToF Premiere™ mass spectrometer (Waters®, Milford, Mass.) coupled with a NanoAcquity™ nano-LC system (Waters®, Milford, Mass.) with a gradient from 2% acetonitrile, 0.1% formic acid to 60% acetonitrile, 0.1% formic acid. The resulting LC-MS data were analyzed using Protein Lynx Global Server (Waters®, Milford, Mass.) to generate DeNovo sequence data. Mass Spectrometry sequence results indicated the IPD079Aa polypeptide (SEQ ID NO: 2) was Perforin-Like when searched against the transcriptome sequence database of *Huperzia phlegmaria* (Id. #PS-8582) described in Example 3.

Example 3—Transcriptome Sequencing of *Huperzia phlegmaria*

A transcriptome for *Huperzia phlegmaria*, (Id. #PS-8582) was prepared as follows. Total RNA was isolated from frozen tissues by use of an RNeasy® kit (Qiagen®) for total RNA isolation. Sequencing libraries from the resulting total RNA were prepared using the TruSeq™ mRNA-Seq kit and protocol from Illumina®, Inc. (San Diego, Calif.). Briefly, mRNAs were isolated via attachment to oligo(dT) beads, fragmented to a mean size of 180 nt, reverse transcribed into cDNA by random hexamer prime, end repaired, 3' A-tailed, and ligated with Illumina® indexed TruSeq™ adapters. Ligated cDNA fragments were PCR amplified using Illumina® TruSeq™ primers and purified PCR products were checked for quality and quantity on the Agilent Bioanalyzer® DNA 7500 chip. Post quality and quantity assessment, 100 ng of the transcript library was normalized by treatment with Duplex Specific Nuclease (DSN) (Evrogen®, Moscow, Russia). Normalization was accomplished by addition of 200 mM Hepes buffer, followed by heat denaturation and five hour anneal at 68° C. Annealed library was treated with 2 μl of DSN enzyme for 25 minutes, purified by Qiagen® MinElute® columns according to manufacturer protocols, and amplified twelve cycles using Illumina® adapter specific primers. Final products were purified with Ampure® XP beads (Beckman Genomics, Danvers, Mass.) and checked for quality and quantity on the Agilent Bioanalyzer® DNA 7500 chip.

Normalized transcript libraries were sequenced according to manufacturer protocols on the Illumina® Genome Analyzer IIx. Each library was hybridized to two flowcell lanes and amplified, blocked, linearized and primer hybridized using the Illumina clonal cluster generation process on cBot®. Sequencing was completed on the Genome Analyzer IIx, generating sixty million 75 bp paired end reads per normalized library.

Peptide sequences identified for IPD079Aa (SEQ ID NO: 2) by LC-MS sequencing (described in Example 3) were searched against the protein sequences predicted by open reading frames (ORFs) from the internal transcriptome for PS-8582 assemblies. The peptides gave a perfect match to a transcript corresponding to IPD079Aa (SEQ ID NO: 1). The coding sequences were used to design the following primers: GATTACCATATGGCCCAAATAGAGC (SEQ ID NO: 1249) and GCTAACTCGAGCTAGTCTAAATGACG (SEQ ID NO: 1250) to clone the IPD079Aa coding sequence. This clone was produced by polymerase chain reaction using the HF Advantage® PCR kit (Clontech™, 1290 Terra *Bella* Ave. Mountain View, Calif. 94043) and the cDNA prepared from the total RNA from *Huperzia phlegmaria* using the SuperScript® II kit (Thermo Fischer Scientific, Waltham, Mass.) as the template. The cloned sequence was confirmed by sequencing. Based on the DNA and protein sequencing, the IPD079Aa polynucleotide sequence is shown as SEQ ID NO: 1 and the IPD079Aa polypeptide sequence as SEQ ID NO: 2.

Example 4—Identification of the Insecticidal Protein IPD079Ea Active Against *Diabrotica* Species from *Ophioglossum pendulum*

The insecticidal protein IPD079Ea (SEQ ID NO: 56) was identified by protein purification, mass spectrometry (MS) and PCR cloning from *Ophioglossum pendulum* (L.), (Id. #PS-9145) as follows. A sample of *Ophioglossum pendulum* (L.). (Id. #PS-9145) was collected, flash frozen in liquid $N_2$ and stored at −80° C. After storage it was ground to a fine powder at liquid $N_2$ temperatures with a Geno/Grinder® Ball Mill (SPEX Sample Prep LLC, Metuchen, N.J.). To extract protein, 20 ml of 50 mM Tris buffer, pH 8.0, 150 mM KCl, 2.5 mM EDTA, 1.5% polyvinylpolypyrrolidone (PVPP) and protease inhibitor cocktail (Roche Diagnostics, Germany) was added to every 5 grams of fresh weight of tissue. The homogenate was centrifuged to remove cell debris, filtered through 0.22 μm filters and desalted using 10 ml Zeba™ Spin Desalting columns (Thermo Scientific, IL.).

In-vitro bioassays against Western corn root worm (WCRW) (*Diabrotica virgifera virgifera*) were conducted using the desalted protein extract overlaid onto an agar-based Coleoptera diet (Southland Products Inc., Lake Village, Ark.) in a 96-well plate format. Three numbers of replicates were used per sample. Samples were allowed to dry on top of the diet and five to eight neonate insects were placed into each well of the treated plate. After 72 hours of incubation at 27° C., larvae were scored for mortality or severity of stunting. The scores were recorded numerically as dead (3), severely stunted (2) (little or no growth but alive and equivalent to a 1st instar larvae), stunted (1) (growth to second instar but not equivalent to controls), or normal (0). Subjecting the sample to proteinase K and heat treatments resulted in loss of activity indicating that the sample was proteinaceous in nature. Bioassay results are shown in Table 2.

TABLE 2

Activity of *O. pendulum* (L.) Protein Extract Against Western Corn Root Work Larvae

| Average Score of Desalted material | Average score after proteinase K/Heat Treatment |
|---|---|
| 3 | 0 |

Example 5—Purification of the IPD079Ea Homologs

The protein purification scheme is listed as the following, 10 g of PS-9145 plant material was ground and the protein was extracted and desalted as described in Example 1. The desalted material was applied to a 1 ml GE HiTrap™ Q column (GE, Piscataway, N.J.) Protein was eluted from the column with a linear 100 column volume gradient from 0 to 0.7 M NaCl in 50 mM Tris, pH 8.0 and collected 1.0 ml fractions. The eluted fractions that showed WCRW activity through in-vitro bioassay (as described above) were pooled and concentrated 3 to 6 fold using Amicon® 3 kD molecular weight cutoff filtration (Millipore, Billerica, Mass.) The concentrated fractions were separated on SDS-PAGE, stained with Coomassie® and the ~55 kD stained band was excised and digested with Trypsin for MS analysis.

Protein sequencing and identification was performed by Mass Spectrometry (MS) analysis after protein digestion with trypsin. Proteins for MS identification were obtained after running the sample on an LDS-PAGE gel stained with Coomassie® Brilliant Blue G-250. The bands of interest were excised from the gel, de-stained, reduced with dithiothreitol and then alkylated with iodoacetamide. Following overnight digestion with trypsin, the samples were submitted for liquid chromatography-mass spectrometry (LC-MS) analysis. LC-MS analysis for tryptically-digested peptides was performed using electrospray on a QToF Premiere™ mass spectrometer (Waters®, Milford, Mass.) coupled with a NanoAcquity™ nano-LC system (Waters®, Milford, Mass.) with a gradient from 2% acetonitrile, 0.1% formic acid to 60% acetonitrile, 0.1% formic acid. The resulting LC-MS data were analyzed using Protein Lynx Global Server (Waters®, Milford, Mass.) to generate DeNovo sequence data.

Example 6—Coleoptera Assays with Purified IPD079 and IPD094 Polypeptides Expressed in *E. coli*

The IPD079Aa polynucleotide (SEQ ID NO: 1) encoding the IPD079Aa polypeptide (SEQ ID NO: 2) was subcloned into the pET14b vector (Novagen) using the NdeI/XhoI restriction sites in frame with an N-terminal 6×His tag followed by a thrombin cleavage site. The gene (SEQ ID NO: 1) encoding IPD079Aa (SEQ ID NO: 2) was also amplified with the forward primer of SEQ ID NO: 154 and reverse primer of SEQ ID NO: 155 for ligation into a pET28 vector with an N-terminal 6× His tag followed by the *E. coli* maltose binding protein (Duplay et al. (1984) *J. Biol. Chem.* 259:10606-10613). The IPD079Ea polynucleotide (SEQ ID NO: 55) encoding the IPD079Ea polypeptide (SEQ ID NO: 56) was amplified from cDNA prepared from the total RNA from *Ophioglossum pendulum* using forward primer of SEQ ID NO: 1251 and reverse primer of SEQ ID NO: 1252. The resulting PCR product was subcloned using the Gibson Assembly Cloning Kit (NEB) into a pET28 vector with an N-terminal 6× His tag followed by the *E. coli* maltose binding protein. The IPD094Aa polynucleotide (SEQ ID NO: 143) encoding the IPD094Aa polypeptide (SEQ ID NO: 144) was amplified from cDNA prepared from the total RNA from *Selaginella victoriae* using forward primer SEQ ID NO: 1253 and reverse primer SEQ ID NO: 1254. The resulting PCR product was subcloned into a pET28 vector with an N-terminal 6× His tag followed by *E. coli* maltose binding protein. Chemically competent OverExpress™ C41 (DE3) (Miroux B. et al. *Journal of Molecular Biology* 260:289-298, 1996) *E. coli* cells (Lucigen Corp. Middleton, Wis. 53562) were transformed with pET plasmid DNA, containing the respective IPD079 gene insert for recombinant protein expression. The transformed *E. coli* cells were grown overnight at 37° C. with kanamycin selection and then inoculated to a fresh 2×YT medium (1:25) and further grown to an optical density of about 0.8. Protein expression was induced by adding 0.3 mM IPTG and cells were further grown at 16° C. for 16 hours. The *E. coli* expressed proteins were purified by immobilized metal ion chromatography using Ni-NTA agarose (Qiagen®, Germany) or amylose resin (NEB) according to the manufacturer's protocols. The purified fractions were loaded onto PD-10 desalting columns (GE Life Sciences, Pittsburgh, USA) pre-equilibrated with 1×PBS buffer. 3 mL of elute buffer was loaded on to each column and 2.5 mL of eluate collected from each column.

A series of concentrations of the purified protein sample were assayed against Coleoptera insects and concentrations for 50% mortality (LC50) or inhibition of 50% of the individuals (IC50) were calculated. To measure insecticidal activities of the IPD079 proteins against WCRW (*Diabrotica virgifera*) diet incorporation bioassays were conducted using 20 μL of the purified protein samples mixed with 75 μL artificial WCRW diet (Bio-Sery F9800B based) in each of a 96 well bioassay plate then air dried. One larva after feeding on diet at the same dose for one day was placed into each well of the 96 well plate. The assay was run for six (1+5) days at 25° C. with no light and then scored for mortality and stunting. To measure insecticidal activities of the IPD079 proteins against NCRW (*Diabrotica barberi*) diet incorporation bioassays were conducted using 10 μL of the purified protein samples mixed with 50 μL artificial WCRW diet (Bio-Sery F9800B based) in each of a 96 well bioassay plate then air dried. Two neonate larvae after feeding on diet at the same dose for one day was placed into each well of the 96 well plate. The assay was run for four (1+3) days at 25° C. with no light and then scored for mortality and stunting. The WCRW and NCRW results for IPD079Aa (SEQ ID NO: 2), IPD079Ea (SEQ ID NO: 56) and IPD094Aa (SEQ ID NO: 144), expressed and purified from an *E. coli* expression system utilizing an amino-terminal poly-histidine fusion tag (NT His) or maltose binding protein (MBP) fusion, are shown in Table 3.

TABLE 3

| Protein | WCRW Activity | NCRW activity |
|---|---|---|
| NT His IPD079Aa (SEQ ID NO: 2) | LC50 = 90-124 ppm IC50 = 24-61 ppm | LC50~99 ppm ILC50~11 ppm |
| MBP IPD079Aa (SEQ ID NO: 2) | LC50 = 48 ppm IC50 = 20 ppm | Not tested |
| MBP IPD079Ea (SEQ ID NO: 56) | LC50 = 6.9 ppm IC50 = 4.1 ppm | LC50 = 7.3 ppm ILC50 = 3.0 ppm |
| NT His IPD094Aa (SEQ ID NO: 144) | LC50 = 28 ppm IC50 = 13 ppm | LC50 > 200 ppm ILC50 = 93 ppm |

The IPD079Aa polypeptide (SEQ ID NO: 2), IPD079Ea polypeptide (SEQ ID NO: 54), and IPD094Aa polypeptide (SEQ ID NO: 144) were also tested against SCRW (*Diabrotica undecimpunctata howardi*). Bioassays were conducted using 10 μL of the purified protein samples mixed with 50 μL artificial SCRW diet (Bio-Serv F9800B based) in each of a 96 well bioassay plate (BD Falcon 353910). A variable number of *Diabrotica undecimpunctata howardi* neonates (3 to 5) were placed into each well of the 96 well plate. The assay was run for four days at 25° C. with no light and then scored for mortality and stunting. IPD094Aa (SEQ ID NO: 144) was inactive against *Diabrotica undecimpunctata howardi* neonates at concentrations up to 1250 ppm. IPD079Aa was assayed as a clear lysate with a top dose of IPD079Aa at 50 ppm. The data for the IPD079 polypeptides is shown in Table 4.

TABLE 4

| | WCRW | IC50 | SCRW | Highest conc. Tested, ppm | IC50 |
|---|---|---|---|---|---|
| IPD079Aa (SEQ ID NO: 2) | death | 25 ppm | not detected | 50 | |
| IPD079Ea (SEQ ID NO: 56) | death | 6 ppm | death | 1400 | 40 |
| IPD079Ee (SEQ ID NO: 64) | death | 15 ppm | not tested | not tested | |
| IPD079Ef (SEQ ID NO: 66) | death | 4 ppm | not tested | not tested | |
| IPD094Aa (SEQ ID NO: 144) | death | 25-80 ppm | not detected | 1250 | |

Example 7 Lepidoptera Assays with Purified IPD079 Polypeptides Expressed in *E. coli*

Lepidoptera feeding assays were conducted on an artificial diet in a 96 well plate. The purified protein was incorporated with the Lepidopteran-specific artificial diet in a ratio of 10 ul protein to 40 μl of diet mixture. Two to five neonate larvae were placed in each well to feed ad libitum for 5 days. Results were expressed as positive for larvae reactions such as stunting and or mortality. Results were expressed as negative if the larvae were similar to the negative control that is feeding diet to which the above buffer only has been applied.

The IPD079Ea polypeptide (SEQ ID NO: 56) was assayed on European corn borer (*Ostrinia nubilalis*), corn earworm (*Helicoverpa zea*), black cutworm (*Agrotis ipsilon*), and fall armyworm (*Spodoptera frugiperda*). No activity was seen against the Lepidoptera species tested for the IPD079Ea polypeptide (SEQ ID NO: 56) at a concentration up to 2000 ppm. IPD079Aa polypeptide (SEQ ID NO: 2) clear lysate was assayed against the above insects and additionally on velvet bean caterpillar (*Anticarsia gemmatalis*) and Soybean looper (*Pseudoplusia includens*). No activity against the Lepidoptera species was seen for any of the IPD079Aa homologs at protein concentrations up to 50 ppm.

Example 8—Identification of IPD079Aa Homologs

The amino acid sequence of the IPD079Aa polypeptide (SEQ ID NO: 2) was BLAST searched (Basic Local Alignment Search Tool; Altschul, et al., (1993) J. Mol. Biol. 215:403-410; see also ncbi.nlm.nih.gov/BLAST/, which can be accessed using the www prefix) against public and DUPONT-PIONEER internal databases that included plant protein sequences. Amino acid sequences were aligned with proteins in a proprietary DUPONT-PIONEER plant protein database. Homologs of the IPD079Aa polypeptide (SEQ ID NO: 2) were identified in *Huperzia salvinioides* (Id. #PS-9141) and *Huperzia nummulariifolium* (Id. #PS-9151) and were cloned by reverse-transcription using the SuperScript® First-Strand Synthesis System (Invitrogen), according to the manufacturer's instructions, followed by polymerase chain reaction using an HF Advantage® PCR kit (Clontech™, 1290 Terra Bella Ave. Mountain View, Calif. 94043) with primers of SEQ ID NO: 1255 and SEQ ID NO: 1256 for *Huperzia salvinioides* (Id. #PS-9141) and from *Huperzia nummulariifolium* (Id. #PS-9151) using primers of SEQ ID NO: 1257 and SEQ ID NO: 1258. The resulting PCR products were cloned directly into the plasmid vector pCR®-Blunt® II-TOPO® by Zero Blunt® TOPO® cloning (Life Technology). DNA sequencing was performed on random clones. Two unique IPD079 polypeptide homologs, IPD079Ab (SEQ ID NO: 4) and IPD079Ac (SEQ ID NO: 6), were identified from *Huperzia salvinioides* (Id. #PS-9141) and 24 unique IPD079 homologs, IPD079Ad (SEQ ID NO: 8), IPD079Ae (SEQ ID NO: 10), IPD079Af (SEQ ID NO: 12), IPD079Ag (SEQ ID NO: 14), IPD079Ah (SEQ ID NO: 16), IPD079Ai (SEQ ID NO: 18), IPD079Aj (SEQ ID NO: 20), IPD079Ak (SEQ ID NO: 22), IPD079Al (SEQ ID NO: 26), IPD079Am (SEQ ID NO: 28), IPD079An (SEQ ID NO: 30), IPD079Ao (SEQ ID NO: 32), IPD079Ap (SEQ ID NO: 36), IPD079Aq (SEQ ID NO: 38), IPD079Ar (SEQ ID NO: 40), IPD079As (SEQ ID NO: 44), IPD079At (SEQ ID NO: 46), IPD079Au (SEQ ID NO: 48), IPD079Av (SEQ ID NO: 50), IPD079Aw (SEQ ID NO: 52), IPD079Ax (SEQ ID NO: 54), IPD079Ba (SEQ ID NO: 24), IPD079Bb (SEQ ID NO: 34), IPD079Bc (SEQ ID NO: 42) were identified from *Huperzia nummulariifolium* (Id. #PS-9151). The IPD079Aa homologs, source material, polynucleotide coding sequence identifier and IPD079 polypeptide sequence identifier are shown in Table 5. Table 8a-8c shows a matrix table of pair-wise identity relationships for global alignments (void parts of matrix table are not shown), based upon the Needleman-Wunsch algorithm, as implemented in the Needle program (EMBOSS tool suite), of the IPD079Aa homologs of Examples 1, 8, and 10.

TABLE 5

| name | Species | Identification # | Polynucleotide | Polypeptide |
|---|---|---|---|---|
| IPD079Aa | Lycopodium phlegmaria | PS-8582AF | SEQ ID NO: 1 | SEQ ID NO: 2 |
| IPD079Ab | Huperzia salvinioides | PS-9141AF | SEQ ID NO: 3 | SEQ ID NO: 4 |
| IPD079Ac | Huperzia salvinioides | PS-9141AF | SEQ ID NO: 5 | SEQ ID NO: 6 |
| IPD079Ad | Lycopodium nummulariifolium | PS-9151AF | SEQ ID NO: 7 | SEQ ID NO: 8 |
| IPD079Ae | Lycopodium nummulariifolium | PS-9151AF | SEQ ID NO: 9 | SEQ ID NO: 10 |
| IPD079Af | Lycopodium nummulariifolium | PS-9151AF | SEQ ID NO: 11 | SEQ ID NO: 12 |
| IPD079Ag | Lycopodium nummulariifolium | PS-9151AF | SEQ ID NO: 13 | SEQ ID NO: 14 |
| IPD079Ah | Lycopodium nummulariifolium | PS-9151AF | SEQ ID NO: 15 | SEQ ID NO: 16 |
| IPD079Ai | Lycopodium nummulariifolium | PS-9151AF | SEQ ID NO: 17 | SEQ ID NO: 18 |
| IPD079Aj | Lycopodium nummulariifolium | PS-9151AF | SEQ ID NO: 19 | SEQ ID NO: 20 |
| IPD079Ak | Lycopodium nummulariifolium | PS-9151AF | SEQ ID NO: 21 | SEQ ID NO: 22 |
| IPD079Ba | Lycopodium nummulariifolium | PS-9151AF | SEQ ID NO: 23 | SEQ ID NO: 24 |
| IPD079Al | Lycopodium nummulariifolium | PS-9151AF | SEQ ID NO: 25 | SEQ ID NO: 26 |
| IPD079Am | Lycopodium nummulariifolium | PS-9151AF | SEQ ID NO: 27 | SEQ ID NO: 28 |
| IPD079An | Lycopodium nummulariifolium | PS-9151AF | SEQ ID NO: 29 | SEQ ID NO: 30 |
| IPD079Ao | Lycopodium nummulariifolium | PS-9151AF | SEQ ID NO: 31 | SEQ ID NO: 32 |
| IPD079Bb | Lycopodium nummulariifolium | PS-9151AF | SEQ ID NO: 33 | SEQ ID NO: 34 |
| IPD079Ap | Lycopodium nummulariifolium | PS-9151AF | SEQ ID NO: 35 | SEQ ID NO: 36 |
| IPD079Aq | Lycopodium nummulariifolium | PS-9151AF | SEQ ID NO: 37 | SEQ ID NO: 38 |
| IPD079Ar | Lycopodium nummulariifolium | PS-9151AF | SEQ ID NO: 39 | SEQ ID NO: 40 |
| IPD079Bc | Lycopodium nummulariifolium | PS-9151AF | SEQ ID NO: 41 | SEQ ID NO: 42 |
| IPD079As | Lycopodium nummulariifolium | PS-9151AF | SEQ ID NO: 43 | SEQ ID NO: 44 |
| IPD079At | Lycopodium nummulariifolium | PS-9151AF | SEQ ID NO: 45 | SEQ ID NO: 46 |
| IPD079Au | Lycopodium nummulariifolium | PS-9151AF | SEQ ID NO: 47 | SEQ ID NO: 48 |
| IPD079Av | Lycopodium nummulariifolium | PS-9151AF | SEQ ID NO: 49 | SEQ ID NO: 50 |
| IPD079Aw | Lycopodium nummulariifolium | PS-9151AF | SEQ ID NO: 51 | SEQ ID NO: 52 |
| IPD079Ax | Lycopodium nummulariifolium | PS-9151AF | SEQ ID NO: 53 | SEQ ID NO: 54 |
| IPD079Eb | Platycerium bifurcatum | PS-9135AF | SEQ ID NO: 57 | SEQ ID NO: 58 |
| IPD079Ea | Ophioglossum pendulum | PS-9145AF | SEQ ID NO: 55 | SEQ ID NO: 56 |
| IPD079Ec | Ophioglossum pendulum | PS-9145AF | SEQ ID NO: 59 | SEQ ID NO: 60 |
| IPD079Ed | Ophioglossum pendulum | PS-9145AF | SEQ ID NO: 61 | SEQ ID NO: 62 |
| IPD079Ee | Ophioglossum pendulum | PS-9145AF | SEQ ID NO: 63 | SEQ ID NO: 64 |
| IPD079Ef | Ophioglossum pendulum | PS-9145AF | SEQ ID NO: 65 | SEQ ID NO: 66 |
| IPD079Eg | Ophioglossum pendulum | PS-9145AF | SEQ ID NO: 67 | SEQ ID NO: 68 |
| IPD079Eh | Ophioglossum pendulum | PS-9145AF | SEQ ID NO: 69 | SEQ ID NO: 70 |

The IPD079Aa (SEQ ID NO: 1), IPD079Ab (SEQ ID NO: 3), IPD079Ac (SEQ ID NO: 5), IPD079Ad (SEQ ID NO: 7), IPD079Ae (SEQ ID NO: 9), IPD079Af (SEQ ID NO: 11), and IPD079Ba (SEQ ID NO: 23) polynucleotides were cloned into a pET14b vector (Novagen) with a 6×His tag or a pCOLD™ 3 vector (Clontech, 1290 Terra Bella Ave., Mountain View, Calif. 94043) for expression in *E. coli*. In the constructs tested the IPD079Aa polypeptide (SEQ ID NO: 2) was soluble and active against WCRW; IPD079Ab (SEQ ID NO: 4) and IPD079Ac (SEQ ID NO: 6) polypeptides were soluble but were not active against WCRW at the concentrations tested; IPD079Ad (SEQ ID NO: 8), IPD079Ae (SEQ ID NO: 10), IPD079Af (SEQ ID NO: 12), and IPD079Ba (SEQ ID NO: 24) polypeptides were not soluble.

The BLAST search also identified from *Selaginella victoriae* the polypeptide of SEQ ID NO: 144, referred to herein as IPD094Aa, which has 21% sequence identity to IPD079Aa (SEQ ID NO: 2), but was identified based on perforin-like homology. The IPD094Aa polypeptide (SEQ ID NO: 144) is encoded by the polynucleotide of SEQ ID NO: 143.

Example 9—Identification of IPD079Ea Homologs

Homologs of IPD079Ea (SEQ ID NO: 56) were identified in *Ophioglossum pendulum* (Id. #PS-9145) and *Platycerium bifurcatum* (Id. #PS-9135) were cloned by reverse-transcription according to the manufacturer's instructions (Super-Script® First-Strand Synthesis System, Invitrogen), followed by polymerase chain reaction (HF Advantage® PCR kit (Clontech™, 1290 Terra Bella Ave. Mountain View, Calif. 94043) using primers of SEQ ID NO: 1251 and SEQ ID NO: 1252 for *Ophioglossum pendulum* and *Platycerium bifurcatum* using primers of SEQ ID: 156 and SEQ ID NO: 1252. The resulting PCR products were subcloned using the Gibson Assembly® Cloning Kit (New England Biolabs, 240 County Road, Ipswich, Mass. 01938-2723) into a pET28a vector with an N-terminal 6×His tag followed by the *E. coli* Maltose binding protein (Duplay et al. (1984) *J. Biol. Chem.* 259:10606-10613). Six unique IPD079Ea homologs, IPD079Ec (SEQ ID NO: 60), IPD079Ed (SEQ ID NO: 62), IPD079Ee (SEQ ID NO: 64), IPD079Ef (SEQ ID NO: 66), IPD079Eg (SEQ ID NO: 68), IPD079Eh (SEQ ID NO: 70) were identified from *Ophioglossum pendulum* (Id. #PS-9145) and one unique IPD079Ea homolog, IPD079Eb (SEQ ID NO: 58), was identified from *Platycerium bifurcatum* (Id. #PS-9135).

The IPD079Ea homologs, source material, polynucleotide coding sequence identifier and IPD079 polypeptide sequence identifier are shown in Table 6. Table 9a-9c shows a matrix table of pair-wise identity relationships for global alignments (void parts of matrix table are not shown), based upon the Needleman-Wunsch algorithm, as implemented in the Needle program (EMBOSS tool suite), of the IPD079Ea homologs of Examples 4, 9, and 10.

TABLE 6

| name | Species | Identification # | Polynucleotide | Polypeptide |
| --- | --- | --- | --- | --- |
| IPD079Eb | *Platycerium bifurcation* | PS-9135AF | SEQ ID NO: 57 | SEQ ID NO: 58 |
| IPD079Ea | *Ophioglossum pendulum* | PS-9145AF | SEQ ID NO: 55 | SEQ ID NO: 56 |
| IPD079EC | *Ophioglossum pendulum* | PS-9145AF | SEQ ID NO: 59 | SEQ ID NO: 60 |
| IPD079Ed | *Ophioglossum pendulum* | PS-9145AF | SEQ ID NO: 61 | SEQ ID NO: 62 |
| IPD079Ee | *Ophioglossum pendulum* | PS-9145AF | SEQ ID NO: 63 | SEQ ID NO: 64 |
| IPD079Ef | *Ophioglossum pendulum* | PS-9145AF | SEQ ID NO: 65 | SEQ ID NO: 66 |
| IPD079Eg | *Ophioglossum pendulum* | PS-9145AF | SEQ ID NO: 67 | SEQ ID NO: 68 |
| IPD079Eh | *Ophioglossum pendulum* | PS-9145AF | SEQ ID NO: 69 | SEQ ID NO: 70 |

Electrocompetent OverExpress™ C41 (DE3) *E. coli* cells (Miroux B. et al. *Journal of Molecular Biology* 260:289-298, 1996) *E. coli* cells (Lucigen Corp. Middleton, Wis. 53562) were transformed with each pET vector, containing either the IPD079Eb (SEQ ID NO: 58), IPD079Ec (SEQ ID NO: 59), IPD079Ee (SEQ ID NO: 63), or IPD079Ef (SEQ ID NO: 65) gene insert for recombinant protein expression. Transformed *E. coli* cells were grown overnight at 37° C. with kanamycin selection in 3 milliliters of 2×YT medium. One milliliter of this culture was used to inoculate 1 liter of 2×YT medium. When the cultures reached an optical density of about 0.8, protein expression was induced by adding 1 mM IPTG. Cells were further grown at 16° C. for 16 hours. The cells were collected by centrifugation and lysed in 30 microliters 20 mM Tris pH 8 containing ¼× B-PER® II Bacterial Protein Extraction Reagent (Life Technologies) supplemented with Ready-Lyse™ Lysozyme Solution (Epicentre), OmniCleave™ Endonuclease (Epicentre, 5602 Research Park Blvd., Suite 200, Madison, Wis. 53719) and Protease Inhibitor Cocktail Set V (EMD Millipore). The lysate was clarified by centrifugation. The IPD079Ec (SEQ ID NO: 59) gene didn't express to high enough levels for activity determination. The IPD079Eb (SEQ ID NO: 58), IPD079Ee (SEQ ID NO: 64), and IPD079Ef (SEQ ID NO: 66) polypeptides were active in WCRW bioassay.

Example 10—Identification of IPD079 Homologs by 5' and 3' Termini Identity

To identify additional IPD079 homologs alignments of genes homologs of IPD079Aa and IPD079Ea identified in Examples 1, 4, 8 and 9 were used to identify conserved sequences near the 5' and 3' termini of the coding sequences. Multiple PCR primers were designed within these conserved sequences. Reverse-transcription was performed using the SuperScript® First-Strand Synthesis System (Invitrogen) according to the manufacturer's instructions, followed by polymerase chain reaction using Phusion® High-Fidelity DNA Polymerase (New England BioLabs) from *Ophioglossum pendulum* (Id. #PS-9145) using primers 79E_GS_F (SEQ ID NO: 1264), 79_GS_R (SEQ ID NO: 1265), 79E_F1 (SEQ ID NO: 1266), 79E_R1 (SEQ ID NO: 1267) and from *Huperzia goebelii* (Id. #PS-9149) and *Huperzia carinata* (Id. #PS-11847) with primers F1 (SEQ ID NO: 1259), F2 (SEQ ID NO: 1260), F3 (SEQ ID NO: 1261), R1 (SEQ ID NO: 1262), R2 (SEQ ID NO: 1263). The resulting PCR products were cloned directly into the plasmid vector pCR®-Blunt II-TOPO® by Zero Blunt® TOPO® cloning (Life Technology) and DNA sequenced. Twelve unique IPD079Aa homologs, IPD079Ay (SEQ ID NO: 72), IPD079Az (SEQ ID NO: 74), IPD079Bd (SEQ ID NO: 76), IPD079Be (SEQ ID NO: 78), IPD079Bf (SEQ ID NO: 80), IPD079Bg (SEQ ID NO: 82), IPD079Bh (SEQ ID NO: 84), IPD079Bi (SEQ ID NO: 86), IPD079Bj (SEQ ID NO: 88), IPD079Bk (SEQ ID NO: 90), IPD079Bl (SEQ ID NO: 92), IPD079Bm (SEQ ID NO: 94) were identified from *Huperzia goebelii* (Id. #PS-9149) and *Huperzia carinata* (Id. #PS-11847). Twenty-four unique IPD079Ea homologs, IPD079Ei (SEQ ID NO: 96), IPD079Ej (SEQ ID NO: 98), IPD079Ek (SEQ ID NO: 100), IPD079El (SEQ ID NO: 102), IPD079Em (SEQ ID NO: 104), IPD079En (SEQ ID NO: 106), IPD079Eo (SEQ ID NO: 108), IPD079Ep (SEQ ID NO: 110), IPD079Eq (SEQ ID NO: 112), IPD079Er (SEQ ID NO: 114), IPD079Es (SEQ ID NO: 116), IPD079Et (SEQ ID NO: 118), IPD079Eu (SEQ ID NO: 120), IPD079Ev (SEQ ID NO: 122), IPD079Ew (SEQ ID NO: 124), IPD079Ex (SEQ ID NO: 126), IPD079Ey (SEQ ID NO: 128), IPD079Ez (SEQ ID NO: 130), IPD079Eaa (SEQ ID NO: 132), IPD079Eab (SEQ ID NO: 134), IPD079Eac (SEQ ID NO: 136), IPD079Ead (SEQ ID NO: 138), IPD079Eae (SEQ ID NO: 140), IPD079Eaf (SEQ ID NO: 142) were identified from *Ophioglossum pendulum*. The IPD079 homologs, source material, polynucleotide coding sequence identifier, and IPD079 polypeptide sequence identifier are shown in Table 7.

The coding sequences of the IPD079Ea homologs were amplified with primers 79AA_F-2 (SEQ ID NO: 1268), 79AA:5K_F-2 (SEQ ID NO: 1269), 79AA:2V:3N_F-2 (SEQ ID NO: 1270), 79AA_R (SEQ ID NO: 1271), 79EA_F-2 (SEQ ID NO: 1272), 79EA:4K:5T_F-2 (SEQ ID NO: 1273), 79EA_R (SEQ ID NO: 1274) and sub-cloned by Gibson Assembly® (New England BioLabs) into the pET28a vector with an N-terminal 6×His tag followed by the *E. coli* maltose binding protein (Duplay et al. (1984) J. Biol. Chem. 259:10606-10613), for expression in *E. coli*. The IPD079Aa homologs and IPD079Ea homologs shown in Table 7 were solubly expressed and active against WCRW at the concentrations tested except IPD079Bf (SEQ ID NO: 80), IPD079Bk (SEQ ID NO: 90), IPD079Bl (SEQ ID NO: 92), IPD079Bm (SEQ ID NO: 92), and IPD079Ep (SEQ ID NO: 110).

TABLE 7

| | Species | Identification # | DNA Sequence | Protein Sequence |
|---|---|---|---|---|
| IPD079Ay | *Huperzia goebelii* | PS-9149 | SEQ ID NO: 71 | SEQ ID NO: 72 |
| IPD079Az | *Huperzia goebelii* | PS-9149 | SEQ ID NO: 73 | SEQ ID NO: 74 |
| IPD079Bd | *Huperzia carinata* | PS-11487 | SEQ ID NO: 75 | SEQ ID NO: 76 |
| IPD079Be | *Huperzia carinata* | PS-11487 | SEQ ID NO: 77 | SEQ ID NO: 78 |

TABLE 7-continued

| Species | Identification # | DNA Sequence | Protein Sequence |
|---|---|---|---|
| IPD079Bf | *Huperzia carinata* | PS-11487 | SEQ ID NO: 79 | SEQ ID NO: 80 |
| IPD079Bg | *Huperzia carinata* | PS-11487 | SEQ ID NO: 81 | SEQ ID NO: 82 |
| IPD079Bh | *Huperzia carinata* | PS-11487 | SEQ ID NO: 83 | SEQ ID NO: 84 |
| IPD079Bi | *Huperzia carinata* | PS-11487 | SEQ ID NO: 85 | SEQ ID NO: 86 |
| IPD079Bj | *Huperzia carinata* | PS-11487 | SEQ ID NO: 87 | SEQ ID NO: 88 |
| IPD079Bk | *Huperzia carinata* | PS-11487 | SEQ ID NO: 89 | SEQ ID NO: 90 |
| IPD079Bl | *Huperzia carinata* | PS-11487 | SEQ ID NO: 91 | SEQ ID NO: 92 |
| IPD079Bm | *Huperzia carinata* | PS-11487 | SEQ ID NO: 93 | SEQ ID NO: 94 |
| IPD079Ei | *Ophioglossum pendulum* | PS-9145 | SEQ ID NO: 95 | SEQ ID NO: 96 |
| IPD079Ej | *Ophioglossum pendulum* | PS-9145 | SEQ ID NO: 97 | SEQ ID NO: 98 |
| IPD079Ek | *Ophioglossum pendulum* | PS-9145 | SEQ ID NO: 99 | SEQ ID NO: 100 |
| IPD079El | *Ophioglossum pendulum* | PS-9145 | SEQ ID NO: 101 | SEQ ID NO: 102 |
| IPD079Em | *Ophioglossum pendulum* | PS-9145 | SEQ ID NO: 103 | SEQ ID NO: 104 |
| IPD079En | *Ophioglossum pendulum* | PS-9145 | SEQ ID NO: 105 | SEQ ID NO: 106 |
| IPD079Eo | *Ophioglossum pendulum* | PS-9145 | SEQ ID NO: 107 | SEQ ID NO: 108 |
| IPD079Ep | *Ophioglossum pendulum* | PS-9145 | SEQ ID NO: 109 | SEQ ID NO: 110 |
| IPD079Eq | *Ophioglossum pendulum* | PS-9145 | SEQ ID NO: 111 | SEQ ID NO: 112 |
| IPD079Er | *Ophioglossum pendulum* | PS-9145 | SEQ ID NO: 113 | SEQ ID NO: 114 |
| IPD079Es | *Ophioglossum pendulum* | PS-9145 | SEQ ID NO: 115 | SEQ ID NO: 116 |
| IPD079Et | *Ophioglossum pendulum* | PS-9145 | SEQ ID NO: 117 | SEQ ID NO: 118 |
| IPD079Eu | *Ophioglossum pendulum* | PS-9145 | SEQ ID NO: 119 | SEQ ID NO: 120 |
| IPD079Ev | *Ophioglossum pendulum* | PS-9145 | SEQ ID NO: 121 | SEQ ID NO: 122 |
| IPD079Ew | *Ophioglossum pendulum* | PS-9145 | SEQ ID NO: 123 | SEQ ID NO: 124 |
| IPD079Ex | *Ophioglossum pendulum* | PS-9145 | SEQ ID NO: 125 | SEQ ID NO: 126 |
| IPD079Ey | *Ophioglossum pendulum* | PS-9145 | SEQ ID NO: 127 | SEQ ID NO: 128 |
| IPD079Ez | *Ophioglossum pendulum* | PS-9145 | SEQ ID NO: 129 | SEQ ID NO: 130 |
| IPD079Eaa | *Ophioglossum pendulum* | PS-9145 | SEQ ID NO: 131 | SEQ ID NO: 132 |
| IPD079Eab | *Ophioglossum pendulum* | PS-9145 | SEQ ID NO: 133 | SEQ ID NO: 134 |
| IPD079Eac | *Ophioglossum pendulum* | PS-9145 | SEQ ID NO: 135 | SEQ ID NO: 136 |
| IPD079Ead | *Ophioglossum pendulum* | PS-9145 | SEQ ID NO: 137 | SEQ ID NO: 138 |
| IPD079Eae | *Ophioglossum pendulum* | PS-9145 | SEQ ID NO: 139 | SEQ ID NO: 140 |
| IPD079Fa | *Ophioglossum pendulum* | PS-9145 | SEQ ID NO: 141 | SEQ ID NO: 142 |

TABLE 8a

| | IPD079Ab SEQ ID NO: 4 | IPD079Ac SEQ ID NO: 6 | IPD079Ad SEQ ID NO: 8 | IPD079Ae SEQ ID NO: 10 | IPD079Af SEQ ID NO: 12 | IPD079Ag SEQ ID NO: 14 | IPD079Ah SEQ ID NO: 16 |
|---|---|---|---|---|---|---|---|
| IPD079Aa SEQ ID NO: 2 | 92.5 | 92.0 | 91.4 | 90.2 | 91.6 | 91.1 | 90.9 |
| IPD079Ab SEQ ID NO: 4 | — | 99.6 | 91.6 | 90.5 | 91.8 | 91.4 | 91.1 |
| IPD079Ac SEQ ID NO: 6 | — | — | 91.1 | 90.0 | 91.4 | 90.9 | 91.1 |
| IPD079Ad SEQ ID NO: 8 | — | — | — | 98.4 | 98.7 | 99.8 | 96.0 |
| IPD079Ae SEQ ID NO: 10 | — | — | — | — | 97.1 | 98.2 | 95.8 |
| IPD079Af SEQ ID NO: 12 | — | — | — | — | — | 98.4 | 95.3 |
| IPD079Ag SEQ ID NO: 14 | — | — | — | — | — | — | 95.8 |
| IPD079Ah SEQ ID NO: 16 | — | — | — | — | — | — | — |
| IPD079Ai SEQ ID NO: 18 | — | — | — | — | — | — | — |
| IPD079Aj SEQ ID NO: 20 | — | — | — | — | — | — | — |
| IPD079Ak SEQ ID NO: 22 | — | — | — | — | — | — | — |
| IPD079Al SEQ ID NO: 26 | — | — | — | — | — | — | — |
| IPD079Am SEQ ID NO: 28 | — | — | — | — | — | — | — |

| | IPD079Ai SEQ ID NO: 18 | IPD079Aj SEQ ID NO: 20 | IPD079Ak SEQ ID NO: 22 | IPD079Al SEQ ID NO: 26 | IPD079Am SEQ ID NO: 28 | IPD079An SEQ ID NO: 30 |
|---|---|---|---|---|---|---|
| IPD079Aa SEQ ID NO: 2 | 91.8 | 91.6 | 91.8 | 90.2 | 91.8 | 90.9 |
| IPD079Ab SEQ ID NO: 4 | 91.8 | 91.6 | 91.6 | 90.5 | 92.0 | 91.1 |

TABLE 8a-continued

|  |  |  |  |  |  |  |
|---|---|---|---|---|---|---|
| IPD079Ac SEQ ID NO: 6 | 91.4 | 91.1 | 91.1 | 90.0 | 91.6 | 90.7 |
| IPD079Ad SEQ ID NO: 8 | 98.2 | 97.6 | 98.0 | 98.0 | 99.1 | 99.1 |
| IPD079Ae SEQ ID NO: 10 | 97.1 | 96.0 | 96.9 | 96.9 | 98.0 | 98.0 |
| IPD079Af SEQ ID NO: 12 | 98.4 | 98.2 | 98.2 | 97.6 | 98.7 | 97.8 |
| IPD079Ag SEQ ID NO: 14 | 98.0 | 97.8 | 97.8 | 98.2 | 98.9 | 98.9 |
| IPD079Ah SEQ ID NO: 16 | 94.7 | 94.2 | 94.5 | 95.1 | 96.2 | 95.6 |
| IPD079Ai SEQ ID NO: 18 | — | 98.9 | 99.8 | 96.7 | 97.8 | 97.3 |
| IPD079Aj SEQ ID NO: 20 | — | — | 98.7 | 97.8 | 97.6 | 96.7 |
| IPD079Ak SEQ ID NO: 22 | — | — | — | 96.5 | 97.6 | 97.1 |
| IPD079Al SEQ ID NO: 26 | — | — | — | — | 98.0 | 97.1 |
| IPD079Am SEQ ID NO: 28 | — | — | — | — | — | 98.7 |

TABLE 8b

|  | IPD079Ao SEQ ID NO: 32 | IPD079Ap SEQ ID NO: 36 | IPD079Aq SEQ ID NO: 38 | IPD079Ar SEQ ID NO: 40 | IPD079As SEQ ID NO: 44 | IPD079At SEQ ID NO: 46 | IPD079Au SEQ ID NO: 48 |
|---|---|---|---|---|---|---|---|
| IPD079Aa SEQ ID NO: 2 | 91.6 | 91.1 | 90.5 | 90.9 | 90.9 | 91.6 | 90.7 |
| IPD079Ab SEQ ID NO: 4 | 91.8 | 91.4 | 90.7 | 91.1 | 91.1 | 91.8 | 90.9 |
| IPD079Ac SEQ ID NO: 6 | 91.4 | 90.9 | 90.2 | 90.7 | 90.7 | 91.4 | 90.5 |
| IPD079Ad SEQ ID NO: 8 | 98.0 | 99.3 | 98.7 | 98.2 | 98.7 | 98.7 | 98.4 |
| IPD079Ae SEQ ID NO: 10 | 96.5 | 99.1 | 99.8 | 98.0 | 97.6 | 98.0 | 97.3 |
| IPD079Af SEQ ID NO: 12 | 99.1 | 98.0 | 97.3 | 97.8 | 98.2 | 98.2 | 98.0 |
| IPD079Ag SEQ ID NO: 14 | 97.8 | 99.1 | 98.4 | 98.0 | 98.4 | 98.4 | 98.7 |
| IPD079Ah SEQ ID NO: 16 | 94.7 | 95.8 | 96.0 | 95.8 | 95.6 | 96.2 | 95.6 |
| IPD079Ai SEQ ID NO: 18 | 98.9 | 98.0 | 96.9 | 97.3 | 98.7 | 97.3 | 97.1 |
| IPD079Aj SEQ ID NO: 20 | 98.7 | 96.9 | 96.2 | 97.1 | 98.0 | 97.1 | 98.2 |
| IPD079Ak SEQ ID NO: 22 | 98.7 | 97.8 | 96.7 | 97.1 | 98.4 | 97.1 | 96.9 |
| IPD079Al SEQ ID NO: 26 | 96.9 | 97.3 | 97.1 | 98.0 | 97.1 | 97.6 | 99.1 |
| IPD079Am SEQ ID NO: 28 | 98.0 | 98.9 | 98.2 | 98.7 | 98.2 | 98.7 | 98.4 |
| IPD079An SEQ ID NO: 30 | 97.1 | 98.9 | 98.2 | 97.8 | 97.8 | 97.8 | 97.6 |
| IPD079Ao SEQ ID NO: 32 | — | 97.3 | 96.7 | 97.1 | 98.9 | 97.6 | 97.3 |
| IPD079Ap SEQ ID NO: 36 | — | — | 98.9 | 98.4 | 98.0 | 98.0 | 97.8 |
| IPD079Aq SEQ ID NO: 38 | — | — | — | 97.8 | 97.8 | 98.2 | 97.6 |
| IPD079Ar SEQ ID NO: 40 | — | — | — | — | 97.3 | 97.8 | 98.4 |
| IPD079As SEQ ID NO: 44 | — | — | — | — | — | 97.8 | 97.6 |
| IPD079At SEQ ID NO: 46 | — | — | — | — | — | — | 98.0 |
| IPD079Au SEQ ID NO: 48 | — | — | — | — | — | — | — |
| IPD079Av SEQ ID NO: 50 | — | — | — | — | — | — | — |
| IPD079Aw SEQ ID NO: 52 | — | — | — | — | — | — | — |
| IPD079Ax SEQ ID NO: 54 | — | — | — | — | — | — | — |

TABLE 8b-continued

| | | | | | | |
|---|---|---|---|---|---|---|
| IPD079Az SEQ ID NO: 74 | — | — | — | — | — | — |

| | | IPD079Av SEQ ID NO: 50 | IPD079Aw SEQ ID NO: 52 | IPD079Ax SEQ ID NO: 54 | IPD079Az SEQ ID NO: 74 | IPD079Ba SEQ ID NO: 24 |
|---|---|---|---|---|---|---|
| | IPD079Aa SEQ ID NO: 2 | 90.2 | 91.6 | 91.4 | 96.0 | 86.7 |
| | IPD079Ab SEQ ID NO: 4 | 90.5 | 91.8 | 91.8 | 95.6 | 87.6 |
| | IPD079Ac SEQ ID NO: 6 | 90.0 | 91.4 | 91.8 | 95.1 | 87.6 |
| | IPD079Ad SEQ ID NO: 8 | 98.4 | 98.9 | 97.1 | 93.3 | 93.8 |
| | IPD079Ae SEQ ID NO: 10 | 99.6 | 97.8 | 97.3 | 92.2 | 93.6 |
| | IPD079Af SEQ ID NO: 12 | 97.1 | 98.4 | 96.7 | 93.6 | 93.1 |
| | IPD079Ag SEQ ID NO: 14 | 98.2 | 98.7 | 96.9 | 93.1 | 93.6 |
| | IPD079Ah SEQ ID NO: 16 | 95.3 | 96.0 | 97.8 | 93.3 | 92.5 |
| | IPD079Ai SEQ ID NO: 18 | 97.1 | 97.6 | 95.8 | 93.8 | 92.9 |
| | IPD079Aj SEQ ID NO: 20 | 96.0 | 97.3 | 95.6 | 93.6 | 92.2 |
| | IPD079Ak SEQ ID NO: 22 | 96.9 | 97.3 | 95.6 | 93.8 | 92.7 |
| | IPD079Al SEQ ID NO: 26 | 96.9 | 97.8 | 96.5 | 92.2 | 93.1 |
| | IPD079Am SEQ ID NO: 28 | 98.0 | 99.8 | 97.6 | 93.8 | 93.6 |
| | IPD079An SEQ ID NO: 30 | 98.0 | 98.4 | 96.7 | 92.9 | 92.9 |
| | IPD079Ao SEQ ID NO: 32 | 96.5 | 98.2 | 96.0 | 93.6 | 92.5 |
| | IPD079Ap SEQ ID NO: 36 | 99.1 | 98.7 | 97.3 | 93.1 | 93.6 |
| | IPD079Aq SEQ ID NO: 38 | 99.3 | 98.0 | 97.6 | 92.5 | 93.3 |
| | IPD079Ar SEQ ID NO: 40 | 98.0 | 98.4 | 97.1 | 92.9 | 93.8 |
| | IPD079As SEQ ID NO: 44 | 97.1 | 98.4 | 96.2 | 92.9 | 93.3 |
| | IPD079At SEQ ID NO: 46 | 98.0 | 98.4 | 98.0 | 93.6 | 93.3 |
| | IPD079Au SEQ ID NO: 48 | 97.3 | 98.2 | 96.9 | 92.7 | 93.6 |
| | IPD079Av SEQ ID NO: 50 | — | 97.8 | 97.3 | 92.2 | 93.1 |
| | IPD079Aw SEQ ID NO: 52 | — | — | 97.3 | 93.6 | 93.3 |
| | IPD079Ax SEQ ID NO: 54 | — | — | — | 93.8 | 93.1 |
| | IPD079Az SEQ ID NO: 74 | — | — | — | — | 88.7 |

TABLE 8c

| | IPD079Bb SEQ ID NO: 34 | IPD079Bc SEQ ID NO: 42 | IPD079Bd SEQ ID NO: 76 | IPD079Be SEQ ID NO: 78 | IPD079Bf SEQ ID NO: 80 | IPD079Bg SEQ ID NO: 82 | IPD079Bh SEQ ID NO: 84 |
|---|---|---|---|---|---|---|---|
| IPD079Aa SEQ ID NO: 2 | 84.7 | 87.4 | 88.7 | 85.6 | 84.3 | 85.8 | 84.5 |
| IPD079Ab SEQ ID NO: 4 | 82.7 | 85.1 | 86.9 | 84.7 | 82.9 | 84.9 | 83.6 |
| IPD079Ac SEQ ID NO: 6 | 82.5 | 85.1 | 86.7 | 84.7 | 82.9 | 84.9 | 83.6 |
| IPD079Ad SEQ ID NO: 8 | 84.0 | 88.5 | 86.0 | 83.4 | 82.5 | 83.6 | 82.3 |
| IPD079Ae SEQ ID NO: 10 | 83.1 | 87.1 | 85.4 | 82.7 | 81.8 | 82.9 | 81.6 |
| IPD079Af SEQ ID NO: 12 | 84.3 | 88.7 | 86.3 | 83.6 | 82.7 | 83.8 | 82.5 |

TABLE 8c-continued

| | | | | | | | |
|---|---|---|---|---|---|---|---|
| IPD079Ag SEQ ID NO: 14 | 83.8 | 88.2 | 85.8 | 83.1 | 82.3 | 83.4 | 82.0 |
| IPD079Ah SEQ ID NO: 16 | 83.6 | 87.8 | 85.8 | 82.7 | 81.8 | 82.9 | 82.0 |
| IPD079Ai SEQ ID NO: 18 | 84.0 | 88.5 | 86.7 | 84.0 | 83.1 | 84.3 | 82.7 |
| IPD079Aj SEQ ID NO: 20 | 84.3 | 88.2 | 86.3 | 83.6 | 82.7 | 83.8 | 82.3 |
| IPD079Ak SEQ ID NO: 22 | 84.0 | 88.5 | 86.7 | 84.0 | 83.1 | 84.3 | 82.7 |
| IPD079Al SEQ ID NO: 26 | 83.4 | 87.4 | 85.1 | 82.5 | 81.6 | 82.7 | 81.4 |
| IPD079Am SEQ ID NO: 28 | 84.5 | 88.5 | 86.5 | 83.8 | 82.9 | 84.0 | 82.7 |
| IPD079An SEQ ID NO: 30 | 83.8 | 87.8 | 85.6 | 82.9 | 82.5 | 83.1 | 82.3 |
| IPD079Ao SEQ ID NO: 32 | 84.0 | 88.5 | 86.0 | 83.4 | 82.5 | 83.6 | 82.0 |
| IPD079Ap SEQ ID NO: 36 | 83.8 | 87.8 | 86.3 | 83.6 | 82.7 | 83.8 | 82.5 |
| IPD079Aq SEQ ID NO: 38 | 83.4 | 87.4 | 85.1 | 82.5 | 81.6 | 82.7 | 81.4 |
| IPD079Ar SEQ ID NO: 40 | 83.8 | 87.6 | 86.3 | 83.6 | 82.7 | 83.8 | 82.5 |
| IPD079As SEQ ID NO: 44 | 83.4 | 87.8 | 85.4 | 82.7 | 81.8 | 82.9 | 81.4 |
| IPD079At SEQ ID NO: 46 | 84.5 | 89.1 | 86.3 | 83.1 | 82.3 | 83.4 | 82.5 |
| IPD079Au SEQ ID NO: 48 | 84.0 | 88.0 | 85.6 | 82.9 | 82.0 | 83.1 | 81.8 |
| IPD079Av SEQ ID NO: 50 | 83.1 | 87.1 | 85.4 | 82.7 | 81.8 | 82.9 | 81.6 |
| IPD079Aw SEQ ID NO: 52 | 84.3 | 88.2 | 86.3 | 83.6 | 82.7 | 83.8 | 82.5 |
| IPD079Ax SEQ ID NO: 54 | 84.3 | 89.1 | 86.5 | 83.1 | 82.3 | 83.4 | 82.5 |
| IPD079Az SEQ ID NO: 74 | 84.3 | 87.4 | 89.1 | 86.3 | 84.7 | 86.5 | 84.9 |
| IPD079Ba SEQ ID NO: 24 | 81.4 | 84.0 | 85.8 | 87.4 | 86.5 | 87.6 | 86.3 |
| IPD079Bb SEQ ID NO: 34 | — | 93.3 | 86.3 | 79.6 | 78.5 | 79.8 | 78.9 |
| IPD079Bc SEQ ID NO: 42 | — | — | 84.7 | 81.2 | 80.0 | 81.4 | 80.5 |
| IPD079Bd SEQ ID NO: 76 | — | — | — | 93.1 | 90.0 | 93.3 | 89.1 |
| IPD079Be SEQ ID NO: 78 | — | — | — | — | 96.5 | 99.8 | 95.1 |
| IPD079Bf SEQ ID NO: 80 | — | — | — | — | — | 96.7 | 95.6 |
| IPD079Bg SEQ ID NO: 82 | — | — | — | — | — | — | 95.3 |
| IPD079Bh SEQ ID NO: 84 | — | — | — | — | — | — | — |
| IPD079Bi SEQ ID NO: 86 | — | — | — | — | — | — | — |
| IPD079Bj SEQ ID NO: 88 | — | — | — | — | — | — | — |
| IPD079Bk SEQ ID NO: 90 | — | — | — | — | — | — | — |
| IPD079Bl SEQ ID NO: 92 | — | — | — | — | — | — | — |

| | IPD079Bi SEQ ID NO: 86 | IPD079Bj SEQ ID NO: 88 | IPD079Bk SEQ ID NO: 90 | IPD079Bl SEQ ID NO: 92 | IPD079Bm SEQ ID NO: 94 |
|---|---|---|---|---|---|
| IPD079Aa SEQ ID NO: 2 | 84.3 | 84.0 | 81.8 | 81.6 | 81.6 |
| IPD079Ab SEQ ID NO: 4 | 82.3 | 82.0 | 80.5 | 80.3 | 80.3 |
| IPD079Ac SEQ ID NO: 6 | 82.0 | 81.8 | 80.0 | 79.8 | 79.8 |
| IPD079Ad SEQ ID NO: 8 | 81.8 | 81.6 | 80.3 | 80.0 | 80.0 |
| IPD079Ae SEQ ID NO: 10 | 80.9 | 80.7 | 79.6 | 79.4 | 79.4 |
| IPD079Af SEQ ID NO: 12 | 82.0 | 81.8 | 80.3 | 80.0 | 80.0 |

TABLE 8c-continued

| | | | | | |
|---|---|---|---|---|---|
| IPD079Ag SEQ ID NO: 14 | 81.6 | 81.4 | 80.0 | 79.8 | 79.8 |
| IPD079Ah SEQ ID NO: 16 | 81.4 | 81.2 | 80.5 | 80.3 | 80.3 |
| IPD079Ai SEQ ID NO: 18 | 82.0 | 81.8 | 80.3 | 80.0 | 80.0 |
| IPD079Aj SEQ ID NO: 20 | 82.3 | 82.0 | 80.3 | 80.0 | 80.0 |
| IPD079Ak SEQ ID NO: 22 | 82.0 | 81.8 | 80.3 | 80.0 | 80.0 |
| IPD079Al SEQ ID NO: 26 | 81.2 | 80.9 | 79.4 | 79.2 | 79.2 |
| IPD079Am SEQ ID NO: 28 | 82.3 | 82.0 | 80.7 | 80.5 | 80.5 |
| IPD079An SEQ ID NO: 30 | 82.0 | 81.8 | 80.5 | 80.3 | 80.3 |
| IPD079Ao SEQ ID NO: 32 | 82.0 | 81.8 | 80.3 | 80.0 | 80.0 |
| IPD079Ap SEQ ID NO: 36 | 81.6 | 81.4 | 80.0 | 79.8 | 79.8 |
| IPD079Aq SEQ ID NO: 38 | 81.2 | 80.9 | 79.8 | 79.6 | 79.6 |
| IPD079Ar SEQ ID NO: 40 | 81.6 | 81.4 | 80.0 | 79.8 | 79.8 |
| IPD079As SEQ ID NO: 44 | 81.4 | 81.2 | 79.8 | 79.6 | 79.6 |
| IPD079At SEQ ID NO: 46 | 82.3 | 82.0 | 80.9 | 80.7 | 80.7 |
| IPD079Au SEQ ID NO: 48 | 81.8 | 81.6 | 80.0 | 79.8 | 79.8 |
| IPD079Av SEQ ID NO: 50 | 80.9 | 80.7 | 79.6 | 79.4 | 79.4 |
| IPD079Aw SEQ ID NO: 52 | 82.0 | 81.8 | 80.5 | 80.3 | 80.3 |
| IPD079Ax SEQ ID NO: 54 | 82.0 | 81.8 | 80.9 | 80.7 | 80.7 |
| IPD079Az SEQ ID NO: 74 | 83.8 | 83.6 | 82.0 | 81.8 | 81.8 |
| IPD079Ba SEQ ID NO: 24 | 79.4 | 79.2 | 77.4 | 77.2 | 77.2 |
| IPD079Bb SEQ ID NO: 34 | 93.3 | 93.1 | 88.9 | 88.7 | 88.7 |
| IPD079Bc SEQ ID NO: 42 | 88.7 | 88.5 | 86.3 | 86.0 | 86.0 |
| IPD079Bd SEQ ID NO: 76 | 86.0 | 85.8 | 82.9 | 82.7 | 82.7 |
| IPD079Be SEQ ID NO: 78 | 79.2 | 78.9 | 77.2 | 76.9 | 76.9 |
| IPD079Bf SEQ ID NO: 80 | 77.8 | 77.6 | 75.6 | 75.4 | 75.4 |
| IPD079Bg SEQ ID NO: 82 | 79.4 | 79.2 | 77.2 | 76.9 | 76.9 |
| IPD079Bh SEQ ID NO: 84 | 78.3 | 78.0 | 76.1 | 75.8 | 75.8 |
| IPD079Bi SEQ ID NO: 86 | — | 99.8 | 93.8 | 93.6 | 93.6 |
| IPD079Bj SEQ ID NO: 88 | — | — | 93.6 | 93.3 | 93.3 |
| IPD079Bk SEQ ID NO: 90 | — | — | — | 99.8 | 99.8 |
| IPD079Bl SEQ ID NO: 92 | — | — | — | — | 99.6 |

TABLE 9a

| | IPD079Ea SEQ ID NO: 56 | IPD079Eaa SEQ ID NO: 132 | IPD079Eab SEQ ID NO: 134 | IPD079Eac SEQ ID NO: 136 | IPD079Ead SEQ ID NO: 138 | IPD079Eae SEQ ID NO: 140 |
|---|---|---|---|---|---|---|
| IPD079Eb SEQ ID NO: 58 | 99.8 | 98.5 | 97.5 | 97.5 | 95.6 | 95.2 |
| IPD079Ea SEQ ID NO: 56 | — | 98.3 | 97.3 | 97.3 | 95.4 | 95.0 |
| IPD079Eaa SEQ ID NO: 132 | — | — | 97.9 | 97.3 | 94.8 | 93.9 |
| IPD079Eab SEQ ID NO: 134 | — | — | — | 96.2 | 95.6 | 93.9 |

TABLE 9a-continued

| | | | | | | |
|---|---|---|---|---|---|---|
| IPD079Eac SEQ ID NO: 136 | — | — | — | — | 93.1 | 92.7 |
| IPD079Ead SEQ ID NO: 138 | — | — | — | — | — | 94.6 |
| IPD079Eae SEQ ID NO: 140 | — | — | — | — | — | — |
| IPD079Ec SEQ ID NO: 60 | — | — | — | — | — | — |
| IPD079Ed SEQ ID NO: 62 | — | — | — | — | — | — |
| IPD079Ee SEQ ID NO: 64 | — | — | — | — | — | — |
| IPD079Ef SEQ ID NO: 66 | — | — | — | — | — | — |

| | IPD079Ec SEQ ID NO: 60 | IPD079Ed SEQ ID NO: 62 | IPD079Ee SEQ ID NO: 64 | IPD079Ef SEQ ID NO: 66 | IPD079Eg SEQ ID NO: 68 |
|---|---|---|---|---|---|
| IPD079Eb SEQ ID NO: 58 | 93.5 | 99.8 | 95.6 | 99.6 | 97.1 |
| IPD079Ea SEQ ID NO: 56 | 93.3 | 99.6 | 95.4 | 99.4 | 96.9 |
| IPD079Eaa SEQ ID NO: 132 | 92.9 | 98.3 | 96.2 | 98.1 | 97.7 |
| IPD079Eab SEQ ID NO: 134 | 92.1 | 97.3 | 95.6 | 97.1 | 96.4 |
| IPD079Eac SEQ ID NO: 136 | 91.4 | 97.3 | 97.7 | 97.1 | 98.3 |
| IPD079Ead SEQ ID NO: 138 | 89.5 | 95.4 | 93.1 | 95.2 | 94.4 |
| IPD079Eae SEQ ID NO: 140 | 88.7 | 95.0 | 91.2 | 94.8 | 92.5 |
| IPD079Ec SEQ ID NO: 60 | — | 93.3 | 90.4 | 93.1 | 91.4 |
| IPD079Ed SEQ ID NO: 62 | — | — | 95.4 | 99.4 | 96.9 |
| IPD079Ee SEQ ID NO: 64 | — | — | — | 95.2 | 98.5 |
| IPD079Ef SEQ ID NO: 66 | — | — | — | — | 96.7 |

TABLE 9b

| | IPD079Eh SEQ ID NO: 70 | IPD079Ei SEQ ID NO: 96 | IPD079Ej SEQ ID NO: 98 | IPD079Ek SEQ ID NO: 100 | IPD079El SEQ ID NO: 102 | IPD079Em SEQ ID NO: 104 | IPD079En SEQ ID NO: 106 | IPD079Eo SEQ ID NO: 108 | IPD079Ep SEQ ID NO: 110 | IPD079Eq SEQ ID NO: 112 |
|---|---|---|---|---|---|---|---|---|---|---|
| IPD079Eb SEQ ID NO: 58 | 99.6 | 100.0 | 99.8 | 99.8 | 99.0 | 99.6 | 99.0 | 99.2 | 99.4 | 99.0 |
| IPD079Ea SEQ ID NO: 56 | 99.4 | 99.8 | 99.6 | 99.6 | 98.7 | 99.4 | 98.7 | 99.0 | 99.2 | 98.7 |
| IPD079Eaa SEQ ID NO: 132 | 98.1 | 98.5 | 98.7 | 98.7 | 99.2 | 98.5 | 99.2 | 98.5 | 98.7 | 99.6 |
| IPD079Eab SEQ ID NO: 134 | 97.1 | 97.5 | 97.7 | 97.7 | 98.1 | 97.3 | 98.1 | 97.5 | 97.5 | 98.3 |
| IPD079Eac SEQ ID NO: 136 | 97.1 | 97.5 | 97.7 | 97.7 | 97.7 | 97.1 | 98.1 | 97.1 | 96.9 | 97.7 |
| IPD079Ead SEQ ID NO: 138 | 95.2 | 95.6 | 95.4 | 95.4 | 95.4 | 95.4 | 95.0 | 95.2 | 95.6 | 95.2 |
| IPD079Eae SEQ ID NO: 140 | 95.0 | 95.2 | 95.0 | 95.0 | 94.1 | 95.0 | 94.1 | 94.4 | 94.8 | 94.4 |
| IPD079Ec SEQ ID NO: 60 | 93.1 | 93.5 | 93.3 | 93.3 | 93.3 | 93.1 | 93.3 | 93.1 | 93.3 | 93.3 |
| IPD079Ed SEQ ID NO: 62 | 99.4 | 99.8 | 99.6 | 99.6 | 98.7 | 99.4 | 98.7 | 99.0 | 99.2 | 98.7 |
| IPD079Ee SEQ ID NO: 64 | 95.2 | 95.6 | 95.8 | 95.8 | 96.7 | 95.6 | 96.7 | 95.6 | 95.8 | 96.7 |
| IPD079Ef SEQ ID NO: 66 | 99.2 | 99.6 | 99.4 | 99.4 | 98.5 | 99.2 | 98.5 | 98.7 | 99.0 | 98.5 |
| IPD079Eg SEQ ID NO: 68 | 96.7 | 97.1 | 97.3 | 97.3 | 98.1 | 97.1 | 98.1 | 97.1 | 97.3 | 98.1 |

TABLE 9b-continued

|  | IPD079Eh SEQ ID NO: 70 | IPD079Ei SEQ ID NO: 96 | IPD079Ej SEQ ID NO: 98 | IPD079Ek SEQ ID NO: 100 | IPD079El SEQ ID NO: 102 | IPD079Em SEQ ID NO: 104 | IPD079En SEQ ID NO: 106 | IPD079Eo SEQ ID NO: 108 | IPD079Ep SEQ ID NO: 110 | IPD079Eq SEQ ID NO: 112 |
|---|---|---|---|---|---|---|---|---|---|---|
| IPD079Eh SEQ ID NO: 70 | — | 99.6 | 99.4 | 99.4 | 98.5 | 99.2 | 98.5 | 98.7 | 99.0 | 98.5 |
| IPD079Ei SEQ ID NO: 96 | — | — | 99.8 | 99.8 | 99.0 | 99.6 | 99.0 | 99.2 | 99.4 | 99.0 |
| IPD079Ej SEQ ID NO: 98 | — | — | — | 99.6 | 99.2 | 99.4 | 99.2 | 99.4 | 99.2 | 99.2 |
| IPD079Ek SEQ ID NO: 100 | — | — | — | — | 99.2 | 99.4 | 99.2 | 99.0 | 99.2 | 99.2 |
| IPD079El SEQ ID NO: 102 | — | — | — | — | — | 98.5 | 99.6 | 99.0 | 98.7 | 99.6 |
| IPD079Em SEQ ID NO: 104 | — | — | — | — | — | — | 98.5 | 98.7 | 99.4 | 99.0 |
| IPD079En SEQ ID NO: 106 | — | — | — | — | — | — | — | 99.0 | 98.7 | 99.6 |
| IPD079Eo SEQ ID NO: 108 | — | — | — | — | — | — | — | — | 99.0 | 99.0 |
| IPD079Ep SEQ ID NO: 110 | — | — | — | — | — | — | — | — | — | 99.2 |

TABLE 9c

|  | IPD079Er SEQ ID NO: 114 | IPD079Es SEQ ID NO: 116 | IPD079Et SEQ ID NO: 118 | IPD079Eu SEQ ID NO: 120 | IPD079Ev SEQ ID NO: 122 | IPD079Ew SEQ ID NO: 124 | IPD079Ex SEQ ID NO: 126 | IPD079Ey SEQ ID NO: 128 | IPD079Ez SEQ ID NO: 130 | IPD079Fa SEQ ID NO: 142 |
|---|---|---|---|---|---|---|---|---|---|---|
| IPD079Eb SEQ ID NO: 58 | 99.4 | 99.6 | 99.2 | 99.6 | 98.5 | 98.7 | 98.7 | 98.7 | 98.5 | 87.9 |
| IPD079Ea SEQ ID NO: 56 | 99.2 | 99.4 | 99.0 | 99.4 | 98.3 | 98.5 | 98.5 | 98.5 | 98.3 | 87.7 |
| IPD079Eaa SEQ ID NO: 132 | 98.7 | 99.0 | 99.4 | 99.0 | 98.3 | 99.0 | 99.4 | 97.7 | 99.6 | 88.1 |
| IPD079Eab SEQ ID NO: 134 | 97.7 | 97.9 | 97.7 | 97.7 | 97.3 | 97.9 | 98.1 | 96.7 | 98.1 | 89.7 |
| IPD079Eac SEQ ID NO: 136 | 97.3 | 97.5 | 97.1 | 97.1 | 98.1 | 97.5 | 97.5 | 96.7 | 97.3 | 87.7 |
| IPD079Ead SEQ ID NO: 138 | 95.4 | 95.6 | 95.4 | 95.8 | 95.0 | 95.2 | 95.0 | 94.4 | 94.8 | 90.4 |
| IPD079Eae SEQ ID NO: 140 | 94.6 | 94.8 | 94.6 | 95.0 | 94.6 | 93.9 | 94.1 | 93.9 | 93.9 | 88.9 |
| IPD079Ec SEQ ID NO: 60 | 93.3 | 93.5 | 93.1 | 93.5 | 92.5 | 93.3 | 93.1 | 92.3 | 92.9 | 82.4 |
| IPD079Ed SEQ ID NO: 62 | 99.2 | 99.4 | 99.0 | 99.4 | 98.3 | 98.5 | 98.5 | 98.5 | 98.3 | 87.7 |
| IPD079Ee SEQ ID NO: 64 | 95.8 | 96.0 | 96.0 | 96.0 | 96.2 | 96.4 | 96.4 | 94.8 | 96.2 | 87.4 |
| IPD079Ef SEQ ID NO: 66 | 99.0 | 99.2 | 98.7 | 99.2 | 98.1 | 98.3 | 98.3 | 98.3 | 98.1 | 87.4 |
| IPD079Eg SEQ ID NO: 68 | 97.3 | 97.5 | 97.5 | 97.5 | 96.9 | 97.9 | 97.9 | 96.2 | 97.7 | 88.7 |
| IPD079Eh SEQ ID NO: 70 | 99.0 | 99.2 | 98.7 | 99.2 | 98.1 | 98.3 | 98.3 | 98.3 | 98.1 | 87.9 |
| IPD079Ei SEQ ID NO: 96 | 99.4 | 99.6 | 99.2 | 99.6 | 98.5 | 98.7 | 98.7 | 98.7 | 98.5 | 87.9 |
| IPD079Ej SEQ ID NO: 98 | 99.6 | 99.8 | 99.0 | 99.4 | 98.7 | 99.0 | 99.0 | 99.0 | 98.7 | 88.1 |
| IPD079Ek SEQ ID NO: 100 | 99.2 | 99.4 | 99.4 | 99.4 | 98.7 | 99.0 | 99.0 | 98.5 | 98.7 | 87.9 |
| IPD079El SEQ ID NO: 102 | 99.2 | 99.4 | 99.0 | 99.0 | 98.7 | 99.8 | 99.4 | 98.1 | 99.2 | 88.7 |
| IPD079Em SEQ ID NO: 104 | 99.0 | 99.2 | 99.2 | 99.6 | 98.1 | 98.3 | 98.7 | 98.3 | 98.5 | 87.7 |
| IPD079En SEQ ID NO: 106 | 99.2 | 99.4 | 99.0 | 99.0 | 98.7 | 99.4 | 99.4 | 98.1 | 99.2 | 88.7 |
| IPD079Eo SEQ ID NO: 108 | 99.4 | 99.6 | 98.7 | 99.2 | 98.1 | 98.7 | 98.7 | 98.3 | 98.5 | 87.9 |
| IPD079Ep SEQ ID NO: 110 | 99.2 | 99.4 | 99.4 | 99.8 | 97.9 | 98.5 | 99.0 | 98.1 | 98.7 | 87.9 |
| IPD079Eq SEQ ID NO: 112 | 99.2 | 99.4 | 99.4 | 99.4 | 98.7 | 99.4 | 99.8 | 98.1 | 99.6 | 88.5 |
| IPD079Er SEQ ID NO: 114 | — | 99.8 | 99.0 | 99.4 | 98.3 | 99.0 | 99.0 | 98.7 | 98.7 | 88.1 |
| IPD079Es SEQ ID NO: 116 | — | — | 99.2 | 99.6 | 98.5 | 99.2 | 99.2 | 98.7 | 99.0 | 88.3 |

TABLE 9c-continued

| | IPD079Er SEQ ID NO: 114 | IPD079Es SEQ ID NO: 116 | IPD079Et SEQ ID NO: 118 | IPD079Eu SEQ ID NO: 120 | IPD079Ev SEQ ID NO: 122 | IPD079Ew SEQ ID NO: 124 | IPD079Ex SEQ ID NO: 126 | IPD079Ey SEQ ID NO: 128 | IPD079Ez SEQ ID NO: 130 | IPD079Fa SEQ ID NO: 142 |
|---|---|---|---|---|---|---|---|---|---|---|
| IPD079Et SEQ ID NO: 118 | — | — | — | 99.6 | 98.1 | 98.7 | 99.2 | 97.9 | 99.0 | 87.9 |
| IPD079Eu SEQ ID NO: 120 | — | — | — | — | 98.1 | 98.7 | 99.2 | 98.3 | 99.0 | 88.1 |
| IPD079Ev SEQ ID NO: 122 | — | — | — | — | — | 98.5 | 98.5 | 97.7 | 98.3 | 87.4 |
| IPD079Ew SEQ ID NO: 124 | — | — | — | — | — | — | 99.2 | 97.9 | 99.0 | 88.5 |
| IPD079Ex SEQ ID NO: 126 | — | — | — | — | — | — | — | 97.9 | 99.4 | 88.3 |
| IPD079Ey SEQ ID NO: 128 | — | — | — | — | — | — | — | — | 97.7 | 87.0 |
| IPD079Ez SEQ ID NO: 130 | — | — | — | — | — | — | — | — | — | 88.3 |

Electrocompetent OverExpress™ C41 (DE3) *E. coli* cells (Cat. #60341, Lucigen Corp., 2905 Parmenter Street, Middleton, Wis.) were transformed with each pET vector, containing the respective IPD079 gene insert for recombinant protein expression. Transformed *E. coli* cells were grown overnight at 37° C. with kanamycin selection in 3 milliliters of 2×YT medium. One milliliter of this culture was used to inoculate 1 liter of 2×YT medium. When the cultures reached an optical density of about 0.8, protein expression was induced by adding 1 mM IPTG. Cells were further grown at 16° C. for 16 hours. The cells were collected by centrifugation and lysed in 30 microliters 20 mM Tris pH 8 containing ¼× B-PER® II Bacterial Protein Extraction Reagent (Life Technologies) supplemented with Ready-Lyse™ Lysozyme Solution (Epicentre), OmniCleave™ Endonuclease (Epicentre) and Protease Inhibitor Cocktail Set V (EMD Millipore). The lysates were clarified by centrifugation.

The clarified lysates were run in a diet assay to evaluate the effect of the IPD079 polypeptides on larvae of Western Corn Rootworm (WCRW), (*Diabrotica virgifera*). WCRW bioassays were conducted using either diet incorporation and/or diet overlay bioassay procedure. For diet overlay assays, 15 μL of the clarified lysate was applied topically over 65 μL of a modified artificial WCRW larval diet (Bio-Sery F9800B) in each of a 96 well bioassay plate (White Proxi-Plate, Perkin Elmer Catalog #6006299) then air dried. For diet incorporated bioassays, 15 μL of clarified lysate was mixed with 65 μL of modified artificial WCRW larval diet (Bio-Sery F9800B) in each of a 96 well bioassay plate (White Proxi-Plate, Perkin Elmer Catalog #6006299) then air dried for brief period. For both overlay and diet incorporated bioassay process, a variable number of WCRW (*Diabrotica virgifera*) neonates (3 to 10) were placed into each well of the 96 well plate. The assays were run for three days at 27° C. with continuous light and then scored for mortality and stunting. Four to eight repeats were run for each protein sample depending on sample volume availability. Each of the four or eight repeats were scored on a 0-3 scale (0 no effect, 1 slight stunting, 2 severe stunting, 3 mortality) such that the maximum score for each sample was 12 (for four repeats assay) and 24 (for eight repeats assays). Either the average score or cumulative score value was used to differentiate the activity. If a sample scored an average of ≥1, it was considered active at the protein concentration tested in the cleared lysate.

Example 11—Profile HMMs Identification of Plant Perforins

IPD079Aa (SEQ ID NO: 2) and the other members of the IPD079 polypeptide family exemplified show homology to membrane attack complex/perforin (MACPF) domain proteins which has the Pfam ID #IPR020864 (Reference to Pfam database: en.wikipedia.org/wiki/Pfam, which can be accessed using the www prefix).

Plant perforins were identified by querying the protein sequences of IPD079 homologs and Pfam ID #IPR020864 using BLAST and HMMSearch within an in house database of transcriptome assemblies from targeted plant species. Translations of perforin transcriptome HMM hits were generated in all six frames, translations were from Methionine to stop codon, with a protein size of >=50 amino acids. The HMMSearch was repeated on the resulting translations to eliminate incorrect frame translations. Homologs thus identified were aligned using the software MUSCLE (Edgar, Robert C. (2004), Nucleic Acids Research 19; 32(5):1792-7) using the MEGA 6 program (Molecular Evolutionary Genetic Analysis—Tamura K., et al (2013) *Mol. Biol. Evol.* 30 (12): 2725-2729). Phylogenetic analysis was done with the MEGA 6 program, and the Maximum Likelihood method (Jones D. T., et al (1992). *Comp Appl Biosci* 8: 275-282; Tamura K., et al (2013) *Mol. Biol. Evol.* 30 (12): 2725-2729). Branches of the resulting tree were annotated grouped into five major clades and sub-alignments were made for each group.

HMMbuild module of HMMER® 3.0 software suite (Finn, R., *Nucleic Acid Research* 39: Web Server issue W20-W37, 2011) was used to create a profile HMM for IPD079 polypeptide family, based on Multiple Sequence Alignment (MSA), of IPD079 homologs of the disclosure, IPD094Aa (SEQ ID NO: 144) of the disclosure, and the active bacterial perforin AXMI-205 (US Patent Publication 20110023184). Representatives of each major branch were aligned and used to build the HMM. Profile HMMs are statistical models of multiple sequence alignments, or even of single sequences. They capture position-specific information about how conserved each column of the alignment is, and which residues are likely. HMMER® (bio-sequence analysis using profile hidden Markov models) is used to search sequence databases for homologs of protein sequences, and to make protein sequence alignments. HMMER® can be used to search sequence databases with single query sequences, but it becomes particularly powerful when the query is a multiple sequence alignment of a sequence family. HMMER® makes a profile of the query that assigns a position-specific scoring system for substitutions, insertions, and deletions. HMMER® profiles are probabilistic models called "profile hidden Markov models" (profile HMMs) (Krogh et al., 1994, *J. Mol. Biol.*, 235:1501-1531; Eddy, 1998, *Curr. Opin. Struct. Biol.*, 6:361-365.; Durbin et al., *Probabilistic Models of Proteins and Nucleic Acids*. Cambridge University Press, Cambridge UK. 1998, Eddy, Sean R., March 2010, HMMER User's Guide Version 3.0, Howard Hughes Medical Institute, Janelia Farm Research Campus, Ashburn Va., USA; U.S. patent publication No. US20100293118). Compared to BLAST, FASTA, and other sequence alignment and database search tools based on older scoring methodology, HMMER® aims to be significantly more accurate and more able to detect remote homologs, because of the strength of its underlying probability models.

All protein sequences that matched the profile HMM of Pfam ID #IPR020864 with an E-value of less than 0.01 and having a length of greater than 250 amino acids were regarded as statistically significant and corresponding to gene family. Since all statistically significant protein hits obtained are members of plant perforin gene family, it is suggested that profile HMM for known active bacterial perforins is specific to prioritize ranking of plant perforins, and identify other members of the plant perforin family. The plant perforin family members of SEQ ID NOs: 158-1248 were identified.

Example 12 Lack of Cross Resistance of IPD079Aa in mCry3A Resistant Strain of WCRW The WCRW strain resistant to mCry3A (RR>92-fold) was developed by selections of WCRW on mCry3A transgenic maize plants with T0 expression level of mCry3A at >10,000 ppm of total proteins in roots six selections on F3, F6, F7, F8, F10, and F12 larvae. Additional selections of WCRW were made on mCry3A transgenic maize plants with T0 expression level of mCry3A at >30,000 ppm of proteins in roots before the larvae were used for cross resistance testing of IPD079Aa (SEQ ID NO: 2). WCRW diet incorporation bioassays were utilized to evaluate the effects of IPD079Aa (SEQ ID NO: 2) on WCRW larvae by the same method as used in Example 5. Insect mortality and severe stunting was scored and used to calculate inhibitory concentrations (1050 and LC50) based on probit analysis. The resistance ratio (RR) was calculated as follows: RR=(LC/IC50 of resistant WCRW)/(LC/IC50 of susceptible WCRW). As shown in Table 10 Cry3A-resistant WCRW insects were sensitive to IPD079Aa (SEQ ID NO: 2).

TABLE 10

| WCRW colony | LC/IC | IPD079Aa, ppm | 95% CL | Resistance Ratio |
|---|---|---|---|---|
| Cry3A sensitive | LC50 | 90.01 | 66-132 | 1 |
|  | IC50 | 24.45 | 19-31 | 1 |
| Cry3A resistant | LC50 | 99.04 | 79-122 | 1.1 |
|  | IC50 | 34.6 | 27-43 | 1.4 |

Example 13 Mode of Action

To understand the mechanism of IPD079 polypeptide toxicity, specific binding of purified IPD079Aa (SEQ ID NO: 2) and IPD079Ea (SEQ ID NO: 56) with WCRW midgut tissue was evaluated by in vitro competition assays. Midguts were isolated from third instar WCRW larvae to prepare brush border membrane vesicles (BBMV) following a method modified from Wolfersberger et al. (*Comp Bioch Physiol* 86A: 301-308 (1987)) using amino-peptidase activity to track enrichment. BBMVs represent the apical membrane component of the epithelial cell lining of insect midgut tissue and therefore serve as a model system for how insecticidal proteins interact within the gut following ingestion.

Recombinant IPD079Aa (SEQ ID NO: 2) and IPD079Ea (SEQ ID NO: 56) were expressed and purified from an *E. coli* expression system utilizing an amino-terminal polyhistidine fusion tag (6×His). The full length purified protein was labeled with Alexa-Fluor® 488 (Life Technologies) and unincorporated fluorophore was separated from labeled protein using buffer exchange resin (Life Technologies, A30006) following manufacturer's recommendations. Prior to binding experiments, proteins were quantified by gel densitometry following Simply Blue® (Thermo Scientific) staining of SDS-PAGE resolved samples that included BSA as a standard.

Binding buffer consisted of 50 mM sodium chloride, 2.7 mM potassium chloride, 8.1 mM disodium hydrogen phosphate, and 1.47 mM potassium dihydrogen phosphate, pH7.5. To demonstrate specific binding and to evaluate affinity, BBMVs (5 µg) were incubated with 1 nM Alexa-labeled IPD079Aa (SEQ ID NO: 2) or IPD079Ea (SEQ ID NO: 56) in 1004 of binding buffer for 1 hour at RT in the absence and presence of increasing concentrations of unlabeled IPD079Aa (SEQ ID NO: 2) or IPD079Ea (SEQ ID NO: 56). Centrifugation at 20,000 g was used to pellet the BBMVs to separate unbound toxin remaining in solution. The BBMV pellet was then washed twice with binding buffer to eliminate remaining unbound toxin. The final BBMV pellet (with bound fluorescent toxin) was solubilized in reducing Laemmli sample buffer, heated to 100° C. for 5 minutes, and subjected to SDS-PAGE using 4-12% Bis-Tris polyacrylamide gels (Life Technologies). The amount of Alexa-labeled IPD079Aa (SEQ ID NO: 2) or IPD079Ea (SEQ ID NO: 56) in the gel from each sample was measured by a digital fluorescence imaging system (Image Quant LAS4000 GE Healthcare). Digitized images were analyzed by densitometry software (Phoretix 1 D, TotalLab, Ltd.)

The apparent affinity of IPD079Aa (SEQ ID NO: 2) for WCRW BBMVs was estimated based on the concentration of unlabeled protein that was needed to reduce the binding of Alexa-labeled IPD079Aa (SEQ ID NO: 2) by 50% ($EC_{50}$ value). This value was approximately 1 µM for IPD079Aa (SEQ ID NO: 2) binding with WCRW BBMVs (FIG. 3).

Figure 4:
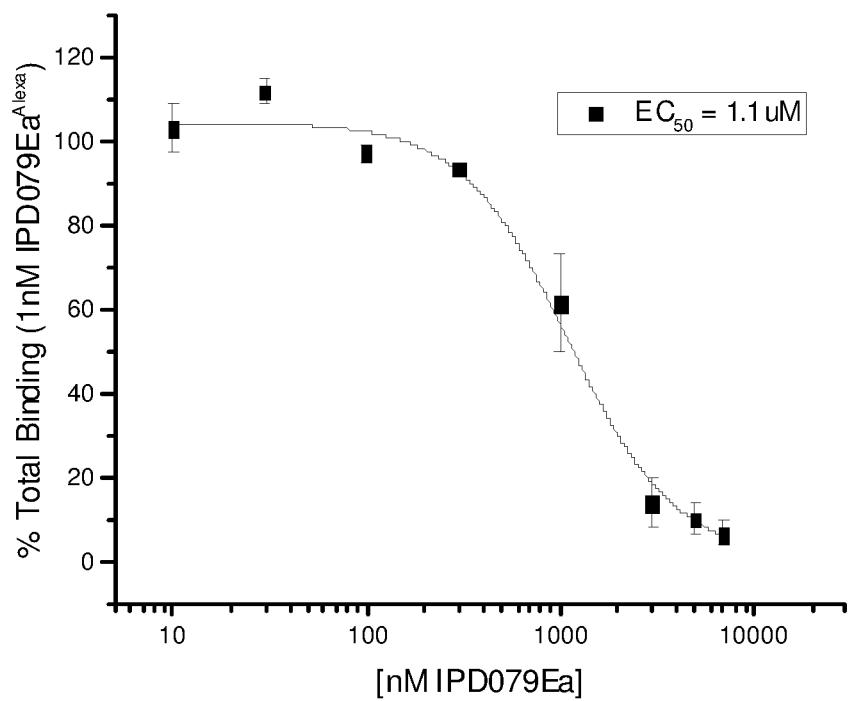
FIG. 4 shows a plot of the homologous competition of 1 nM Alexa-labeled IPD079Ea polypeptide (SEQ ID NO: 56) % total binding to Western Corn Rootworm (WCRW) brush border membrane vesicles (BBMV) versus the concentration (nM) of unlabeled IPD079Ea polypeptide (SEQ ID NO: 56).

Similarly, the apparent affinity of IPD079Ea (SEQ ID NO: 56) for WCRW BBMVs was estimated based on the concentration of unlabeled protein that was needed to reduce the binding of Alexa-labeled IPD079Ea (SEQ ID NO: 56) by 50%. The $EC_{50}$ value for IPD079Ea (SEQ ID NO: 56) binding was approximately 1.1 µM (FIG. 4).

Example 14—Expression Vector Constructs for Expression of IPD079 Polypeptides in Plants Plant expression vectors were constructed to include a transgene cassette containing one of two different gene designs encoding IPD079Aa (SEQ ID NO: 2) and one of two different gene designs encoding IPD079Ea (SEQ ID NO: 56) under control of the Maize ubiquitin promoter in combination with an enhancer element. The resulting constructs, PHP68039, PHP68040, PHP76130, and PHP76131, respectively, were used to generate transgenic maize events to test for efficacy against corn rootworm provided by expression of IPD079Aa (SEQ ID NO: 2) and IPD079Ea (SEQ ID NO: 56) polypeptides.

Example 15 —*Agrobacterium*-Mediated Transformation of Maize and Regeneration of Transgenic Plants For *Agrobacterium*-mediated transformation of maize with IPD079 nucleotide sequences, the method of Zhao was used (U.S. Pat. No. 5,981,840 and PCT Patent Publication Number WO 1998/32326; the contents of which are hereby incorporated by reference). Briefly, immature embryos were isolated from maize and the embryos contacted with a suspension of *Agrobacterium* under conditions whereby the bacteria are capable of transferring the PHP68039, PHP68040, PHP76130, and PHP76131 vectors to at least one cell of at least one of the immature embryos (step 1: the infection step). In this step the immature embryos were immersed in an *Agrobacterium* suspension for the initiation of inoculation. The embryos were co-cultured for a time with the *Agrobacterium* (step 2: the co-cultivation step). The immature embryos were cultured on solid medium following the infection step. Following this co-cultivation period an optional "resting" step is contemplated. In this resting step, the embryos were incubated in the presence of at least one antibiotic known to inhibit the growth of *Agrobacterium* without the addition of a selective agent for plant transformation (step 3: resting step). The immature embryos were cultured on solid medium with antibiotic, but without a selecting agent, for elimination of *Agrobacterium* and for a resting phase for the infected cells. Next, inoculated embryos were cultured on medium containing a selective agent and growing transformed callus is recovered (step 4: the selection step). The immature embryos were cultured on solid medium with a selective agent resulting in the selective growth of transformed cells. The callus was then regenerated into plants (step 5: the regeneration step), and calli grown on selective medium or cultured on solid medium to regenerate the plants.

For detection of the IPD079 proteins in leaf tissue 4 lyophilized leaf punches/sample were pulverized and resuspended in 100 μL PBS containing 0.1% Tween 20 (PBST), 1% beta-mercaptoethanol containing 1 tablet/7 mL complete Mini proteinase inhibitor (Roche 1183615301). The suspension was sonicated for 2 min and then centrifuged at 4° C., 20,000 g for 15 min. To a supernatant aliquot ⅓ volume of 3× NuPAGE® LDS Sample Buffer (Invitrogen™ (CA, USA), 1% B-ME containing 1 tablet/7 mL complete Mini proteinase inhibitor was added. The reaction was heated at 80° C. for 10 min and then centrifuged. A supernatant sample was loaded on 4-12% Bis-Tris Midi gels with MES running buffer as per manufacturer's (Invitrogen™) instructions and transferred onto a nitrocellulose membrane using an iBlot® apparatus (Invitrogen™). The nitrocellulose membrane was incubated in PBST containing 5% skim milk powder for 2 hours before overnight incubation in affinity-purified rabbit anti-IPD079Aa in PBST overnight. The membrane was rinsed three times with PBST and then incubated in PBST for 15 min and then two times 5 min before incubating for 2 hours in PBST with goat anti-rabbit-HRP for 3 hours. The detected proteins were visualized using ECL Western Blotting Reagents (GE Healthcare cat #RPN2106) and Kodak® Biomax® MR film. For detection of the IPD079Aa protein in roots the roots were lyophilized and 2 mg powder per sample was resuspended in LDS, 1% beta-mercaptoethanol containing 1 tablet/7 mL Complete Mini proteinase inhibitor was added. The reaction was heated at 80° C. for 10 min and then centrifuged at 4° C., 20,000 g for 15 min. A supernatant sample was loaded on 4-12% Bis-Tris Midi gels with MES running buffer as per manufacturer's (Invitrogen™) instructions and transferred onto a nitrocellulose membrane using an iBlot® apparatus (Invitrogen™). The nitrocellulose membrane was incubated in PBST containing 5% skim milk powder for 2 hours before overnight incubation in affinity-purified polyclonal rabbit anti-IPD079 antibody in PBST overnight. The membrane was rinsed three times with PBST and then incubated in PBST for 15 min and then two times 5 min before incubating for 2 hours in PBST with goat anti-rabbit-HRP for 3 hrs. The antibody bound insecticidal proteins were detected using ECL™ Western Blotting Reagents (GE Healthcare cat #RPN2106) and Kodak® Biomax® MR film.

Transgenic maize plants positive for expression of the insecticidal proteins are tested for pesticidal activity using standard bioassays known in the art. Such methods include, for example, root excision bioassays and whole plant bioassays. See, e.g., US Patent Application Publication Number U.S. 2003/0120054 and International Publication Number WO 2003/018,810.

Example 16—Greenhouse Efficacy of IPD079 Polypeptide Events

Figure 5:
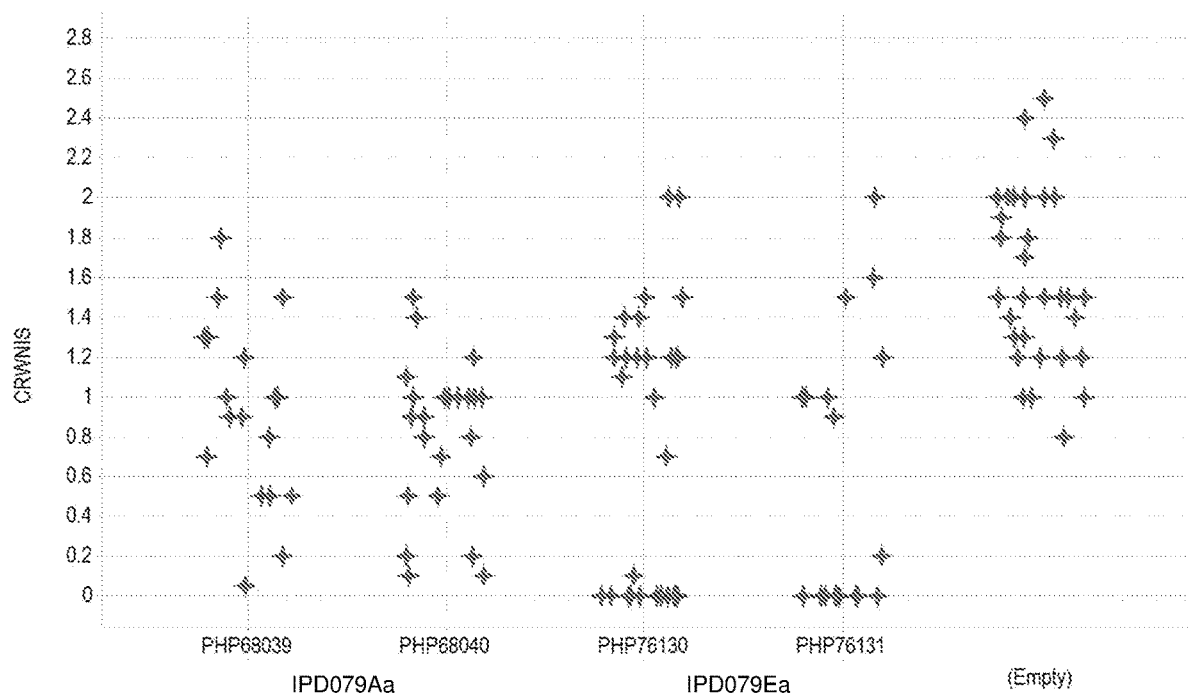
FIG. 5 shows a plot of the corn rootworm node injury score (CRWNIS) for individual events transformed with PHP68039, PHP68040, PHP76130, and PHP76131 constructs containing gene designs encoding IPD079Aa polypeptide (SEQ ID NO: 2) and IPD079Ea polypeptide (SEQ ID NO: 56) compared to the negative control events containing the construct lacking a IPD079 polynucleotide (Empty). Each "✦" symbol represents an individual event.

T0 greenhouse efficacy results for events generated from PHP68039, PHP68040, PHP76130, and PHP76131 constructs are shown in FIG. 5. Efficacy for events derived from all 4 constructs was observed relative to negative control events (Empty) as measured by root protection from Western corn rootworm. Root protection was measured according to the number of nodes of roots injured (CRWNIS=corn rootworm node injury score) using the method developed by Oleson, et al. (2005) [J. Econ Entomol. 98(1):1-8]. The root injury score is measured from "0" to "3" with "0" indicating no visible root injury, "1" indicating 1 node of root damage, "2" indicating 2 nodes or root damage, and "3" indicating a maximum score of 3 nodes of root damage. Intermediate scores (e.g. 1.5) indicate additional fractions of nodes of damage (e.g. one and a half nodes injured). FIG. 5 shows that the majority of events from PHP68039, PHP68040, PHP76130, and PHP76131) performed better than the negative control and have rootworm injury scores of <1.0.

Example 17—Chimeric IPD079 Polypeptides

To generate active IPD079 variants with diversified sequences, chimeras between IPD079Aa (SEQ ID NO: 2) and IPD079Ea (SEQ ID NO: 56) were generated by multi-PCR fragments overlap assembly (Gibson Assembly Cloning Kit, New England Biolabs Inc.). A total of 3 chimeras were constructed: Table 11 shows the crossover points, the % sequence identity to IPD079Aa (SEQ ID NO: 2) and the western corn rootworm activity results. The chimeras designated as 79Chimera1 (SEQ ID NO: 1277) starts with IPD079Aa sequence at its N-terminus whereas the chimeras designated as 79Chimera2 (SEQ ID NO: 1278) and 79Chimera3 (SEQ ID NO: 1275) start with IPD079Ea sequence at their N-termini. An amino acid sequence alignment of IPD079Aa (SEQ ID NO: 2), IPD079Ea (SEQ ID NO: 56), 79Chimera1 (SEQ ID NO: 1277), 79Chimera2 (SEQ ID NO: 1278), and 79Chimera3 (SEQ ID NO: 1276) is shown in FIG. 6.

TABLE 11

| Chimera Designation | crossover position | % Sequence identity to IPD079Aa (SEQ ID NO: 2) | WCRW active |
|---|---|---|---|
| Chimera 1 SEQ ID NO: 1277 | T147 | 72 | No |
| Chimera 2 SEQ ID NO: 1278 | P286 | 83 | No |
| Chimera 3 SEQ ID NO: 1276 | I352 | 76 | Yes |

Crossover position numbers are based on the alignment shown in FIG. 6

The above description of various illustrated embodiments of the disclosure is not intended to be exhaustive or to limit the scope to the precise form disclosed. While specific embodiments of and examples are described herein for illustrative purposes, various equivalent modifications are possible within the scope of the disclosure, as those skilled in the relevant art will recognize. The teachings provided herein can be applied to other purposes, other than the examples described above. Numerous modifications and variations are possible in light of the above teachings and, therefore, are within the scope of the appended claims.

These and other changes may be made in light of the above detailed description. In general, in the following claims, the terms used should not be construed to limit the scope to the specific embodiments disclosed in the specification and the claims.

The entire disclosure of each document cited (including patents, patent applications, journal articles, abstracts, manuals, books or other disclosures) in the Background, Detailed Description, and Examples is herein incorporated by reference in their entireties.

Efforts have been made to ensure accuracy with respect to the numbers used (e.g. amounts, temperature, concentrations, etc.) but some experimental errors and deviations should be allowed for. Unless otherwise indicated, parts are parts by weight, molecular weight is average molecular weight; temperature is in degrees centigrade; and pressure is at or near atmospheric.

SEQUENCE LISTING (1278 sequences)

SEQ ID NO: 1 - DNA, 1353 bp, Lycopodium phlehmaria
atggcccaaatagagccattacctggatcggatgcaatcggactcagttatgatgtattcggattttacgccaaccccaagagcgttaatagacagctcttcgactttgcccctcagcaagaaattactttagaggaccacacatggctcctctccactgatattgtatatattgctgtacgcgatacggatataaacaccgtctctcttcgcacaaaagatgcatactccacggagctggctgcaagcgtaaaagtatccggcagctatggcagcttctcggcttcggtagagtctgatttctcccaaagcatcagcgatgagacggattccacttacacttcagttcgtacaaatgtgaacaagtggaagctcagtctgaagccaactgtggaagaactgcgttccatgttgacaccttcgttcaaggaagctttggcgagtatgaactcggaggagctgtttacgacgtacggaacacattatctgaatgaggtgttggtgggaggtcgcgcagattatgtcgccaccaccaaaaccagtgcattcagctctgatactaaaatcagcgtagttgcggagagttcattcaagtcagtggctggcatggaggtatccgccgagtacaaggagcttatcaagaaattccaagagaacagctccactagtctgtacgccctcggtgggaccgcactctccagcatcacagacacggccagttacaacgcatggttcagttcgattgatacacttcccgtcttctgtggattcacttacgaaagtcttcagcccatctgggaactcgctgaatcccctcagcgccaggagatcctccagaaggctacgaagacctttattccgcccgaaatcagacgaaatgcaatcgtcgacgtagatattatcgtgtccgacaactattgggtgaatcctccctacggctatacgaagatcgattatgatctgaaccgcaatgccaagggcaaatatatctttttgtgctacaatcaacagaagatatcagtagcaggatcccctgcggatccgacgcccatcactgccttgtacgtggcttctggcgatgacgatcatccatacgttcctctaggttataccaggatcaacagcgatctgaacgagggtgcggggggcaaatatatctatctatgctacacaaaagatccggctgcaatacccagcgacgaggatggactgcccatacgtggcatccgcgttattggtaatgaaaaagtcgagaatgtggttacaccttacggattcacgaagattgataaagatctgaacgagggtgcaggaggagactatatcttcgtttgtttctcacgtcatttagac

SEQ ID NO: 2 - protein, 451 aa, Lycopodium phlehmaria
MAQIEPLPGSDAIGLSYDVFGFYANPKSVNRQLFDFAPQQEITLEDHTWLLSTDIVYIAVRDTDINTVSLRTKDAYSTELAASVKVSGSYGSFSASVESDFSQSISDETDSTYTSVRTNVNKWKLSLKPTVEELRSMLTPSFKEALASMNSEELFTTYGTHYLNEVLVGGRADYVATTKTSAFSSDTKISVVAESSFKSVAGMEVSAEYKELIKKFQENSSTSLYALGGTALSSITDTASYNAWFSSIDTLPVFCGFTYESLQPIWELAESPQRQEILQKATKTFIPPEIRRNAIVDVDIIVSDNYWVNPPYGYTKIDYDLNRNAKGKYIFLCYNQQKISVAGSPADPTPITALYVASGDDDHPYVPLGYTRINSDLNEGAGGKYIYLCYTKDPAAIPSDEDGLPIRGIRVIGNEKVENVVTPYGFTKIDKDLNEGAGGDYIFVCFSRHLD

SEQ ID NO: 3 - DNA, 1353 bp, Huperzia salvinioides
atggcccaaatagagccattacctggatcggatgcaatcggacacagttatgacgtattcggattttacgccaaccccaagagcgttaatagccagctcttcgactttgcccctcagcaagaaattattttagaggaccacaaatggctcctctccactgatattgtatatgttgctgtccgggatacggatataaaaaccgtctctctttgcacaaaagatgaatactccacggagctggctgcaagcgtaaaattgtccggcagctatggcagcttctcggcttcggtagagtctgatttctcccaaagcatcagcgatgacacggattccacttacacttcagttcgtacaaatgtgaacaagtggaagctcagtctgaagccaactgtggaagaactgcgttccatgttgacaccttcgttcaaggaagctttggcgagtatgaactcggaggagctgtttacgacgtacggaacacattatctgagtgaggtgttggtgggaggtcgcgcagattatgtcgccaccaccaaaaccagtgcattcagctctgatattcaaatcagcgtagttgcggagagttcattcaagtccgtggctggcatggacgtatcatccaagtacaaggaacttatccagatattccaagagaacagcttcactagtctgtacgccatcggtgggaccgcactctccagcatcacagacacggacacttacaatgcatggctcagttcgattgatacacttcccgtcttctgtggattcacttgcgaaagtcttcagcccatctgggaactcgctgaatcccctcagcgccaggagatcctccagaaggctacgatgacctttattccgcccgaaatcagacgaaatgcgatcgtcgacgtagatattatcgtgtccgacaactattcggtgaatcctccctacggctatacgaagatcgattatgatctgaaccgcaatgccgagggcaaatatatctttttgtgctacaatcaacagaagatatcagtagcaggatcccctgcggatccgaagcccatcaccgccttggacgtggcttctggcgatgacgatgatccagacgttcctcctggttataccaggatcaacagcgatctgaacgagggtgcggggggcaaatatatctatctatgctacacaaaagatccggctgcaatacccagcgacgaggatggactgcccatacgtggcatccgcgttattggtaacgaaaaactcgagaatgtggttacaccttacggattcacgaagattgataaagatctgaacgagggtgcagggggagactatgtcttcgtttgtttctcacgtcatttagac

SEQ ID NO: 4 - protein, 451 aa, Huperzia salvinioides
MAQIEPLPGSDAIGHSYDVFGFYANPKSVNSQLFDFAPQQEIILEDHKWLLSTDIVYVAVRDTDIKTVSLCTKDEYSTELAASVKLSGSYGSFSASVESDFSQSISDDTDSTYTSVRTNVNKWKLSLKPTVEELRSMLTPSFKEALASMNSEELFTTYGTHYLSEVLVGGRADYVATTKTSAFSSDIQISVVAESSFKSVAGMDVSSKYKELIQIFQENSFTSLYAIGGTALSSITDTDTYNAWLSSIDTLPVFCGFTCESLQPIWELAESPQRQEILQKATMTFIPPEIRRNAIVDVDIIVSDNYSVNPPYGYTKIDYDLNRNAEGKYIFLCYNQQKISVAGSPADPKPITALDVASGDDDDPDVPPGYTRINSDLNEGAGGKYIYLCYTKDPAAIPSDEDGLPIRGIRVIGNEKLENVVTPYGFTKIDKDLNEGAGGDYVFVCFSRHLD

SEQ ID NO: 5 - DNA, 1353 bp, Huperzia salvinioides
atggcccaaatagagccattacctggatcggatgcaatcggacacagttatgacgtattcggattttacgccaaccccaagagcgttaatagccagctcttcgactttgcccctcagcaagaaattattttagaggaccacaaatggctcctctccactgatattgtatatgttgctgtccgggatacggatataaaaaccgtctctctttgcacaaaagatgaatactccacggagctggctgcaagcgtaaaattgtccggcagctatggcagcttctcggcttcggtagagtctgatttctcccaaagcatcagcgatgacacggattccacttacacttcagttcgtacaaatgtgaacaagtggaagctcagtctgaagccaactgtggaagaactgcgttccatgttgacaccttcgttcaaggaagctttggcgagtatgaactcggaggagctgtttacgacgtacggaacacattatctgagtgaggtgttggtgggaggtcgcgcagattatgtcgccaccaccaaaaccagtgcattcagctctgatattcaaatcagcgtagttgcggagagttcattcaagtccgtggctggcatggacgtatcatccaagtacaaggaacttatccagatattccaagagaacagcttcactagtctgtacgccatcggtgggaccgcactctccagcatcacagacacggacacttacaatgcatggctcagttcgattgatacacttcccgtcttctgtggattcacttgcgaaagtcttcagcccatctgggaactcgctgaatcccctcagcgccaggagatcctccagaaggctacgatgacctttattccgcccgaaatcagacgaaatgcgatcgtcgacgtagatattatcgtgtccgacaactattcggtgaatcctccctacggctatacgaagatcgattatgatctgaaccgcaatgccgagggcaaatatatctttttgtgctacaatcaacagaagatatcagtagcaggatcccctgcggatccgaagcccatcaccgccttggacgtggcttctggcgatgacaatgatccagacgttcctcctggttataccaggatcaacagcgatctgaacgagggtgcggggggcaaatatatctatctatgctacacaaaagatccggctgcaatacccagcgacgaggatggactgcccatacgtggcatccgcgttattggtaacgaaaaactcgagaatgtggttacaccttacggattcacgaagattgataaagatctgaacgagggtgcagagggagactatgtcttcgtttgtttctcacgtcatttagac

SEQ ID NO: 6 - protein, 451 aa, Huperzia salvinioides
MAQIEPLPGSDAIGHSYDVFGFYANPKSVNSQLFDFAPQQEIILEDHKWLLSTDIVYVAVRDTDIKTVSLCTKDEYSTELAASVKLSGSYGSFSASVESDFSQSISDDTDSTYTSVRTNVNKWKLSLKPTVEELRSMLTPSFKEALASMNSEELFTTYGTHYLSEVLVGGRADYVATTKTSAFSSDIQISVVAESSFKSVAGMDVSSKYKELIQIFQENSFTSLYAIGGTALSSITDTDTYNAWLSSIDTLPVFCGFTCESLQPIWELAESPQRQEILQKATMTFIPPEIRRNAIVDVDIIVSDNYSVNPPYGYTKIDYDLNRNAEGKYIFLCYNQQKISVAGSPADPKPITALDVASGDDNDPDVPPGYTRINSDLNEGAGGKYIYLCYTKDPAAIPSDEDGLPIRGIRVIGNEKLENVVTPYGFTKIDKDLNEGAEGDYVFVCFSRHLD

SEQ ID NO: 7 - DNA, 1353 bp, Lycopodium nummulariifolium
atggcccgtatcgagccattacctggatcggatgcaatcggacacagttatgatgtattcggattttacgccaaccccaagagcgttaatacacagctcttcgactttgcccctcagcaagaaattattttagaggaccacaaatggctcctctccactgatattgaatatattgctgtccgagatacggaaataaaaaccgtctctcttcgtacaaaagatgcatactccacggagctggctgcaagcgtaaaagtatccggcagctatggcagcttctcggcttcggtagagtctgatttctcccaaagcatcagcgatgagactgattccacttacacttctgttcgtacaaatgtgaacaagtggaagctcagtctgaagccaactgtggaagaactgcgttccatgttgacaccttcgttcaaggaagctttggcgagtatggactcggaggagctgtttacgacgtacgggacacattatctgagtgaggtgttggtgggaggtcgcgcagattatgtcgccaccaccaaaaccagtgcattcagctctgatattcaaatcagcgtagttgcggagtgttcattcaagtccgtggctggcatggacgtatcagccaagtacaaggagcttatccagaaattccaagagaacagctccactagtctgtacgccatcggtgggaccacaatctccagcatcacagacaaagacacttacaatgcatggctcagttcgattgatacacgtcccgtcttctgtggattcacttacgaaagtcttcagcccatttgggaacttgctgaatcccctcagcgccaggagatcctgcaaaaggctacgaagacctttatttcgcccgaaatcaaacgaaatgcaatcgtcgacgtagatattatcgtgtccgacaactatggggtgaatcctccctacggctatacgaagatcgattatgatctgaaccacaatgccaagggcaaatttatctttttgtgctacaatcaacagaagatatcagtagcaggatcccctgcggatccgaagcccatcactgctttgtacgtggcttctggcgatgacgatcatccatacgttcctccaggctataccaggatcagcagcgatctgaacgagggtgcggggggcaaatttatctatctatgctacacaaaagatccggctgcaatacccagcgacgaggatggactgcccatacgtggcatccgcgttattggtaacgaaaatatcgacaatgtggttacaccttacggattcacgaagattgataaagatctgaacgagggtgcagggggagactttatcttcgttcgtttctcacctcatttagac

SEQ ID NO: 8 - protein, 451 aa, Lycopodium nummulariifolium
MARIEPLPGSDAIGHSYDVFGFYANPKSVNTQLFDFAPQQEIILEDHKWLLSTDIEYIAVRDTEIKTVSLRTKDAYSTELAASVKVSGSYGSFSASVESDFSQSISDETDSTYTSVRTNVNKWKLSLKPTVEELRSMLTPSFKEALASMDSEELFTTYGTHYLSEVLVGGRADYVATTKTSAFSSDIQISVVAECSFKSVAGMDVSAKYKELIQKFQENSSTSLYAIGGTTISSITDKDTYNAWLSSIDTRPVFCGFTYESLQPIWELAESPQRQEILQKATKTFISPEIKRNAIVDVDIIVSDNYGVNPPYGYTKIDYDLNHNAKGKFIFLCYNQQKISVAGSPADPKPITALYVASGDDDHPYVPPGYTRISSDLNEGAGGKFIYLCYTKDPAAIPSDEDGLPIRGIRVIGNENIDNVVTPYGFTKIDKDLNEGAGGDFIFVRFSPHLD

SEQ ID NO: 9 - DNA, 1353 bp, Lycopodium nummulariifolium
atggcccgtatcgagccattacctggatcggatgcaatcggacacagttatgatgtattcggattttacgccaaccccaggagcgttaatacacagctcttcgactttgcccctcagcaagaaattattttagaggaccacaaatggctcctctccactgatattgaatatattgctgtccgagaaaccgaaataaaaaccgtctctcttcgtacaaaagatgcatactccacggagctggctgcaagcgtaaaagtgtccggcagctatggcagcttctcggcttcggtagagtctgatttctcccaaagcatcagcgatgagacggattccacttatacttctgttcgtacaaatgtgaacaagtggaagctcagtctgaagccaactgtggaagaactgcgttccatgttgacaccttcgttcaaggaagctttggcgagtatggacttggaggagctgtttacgacgtacgggacacattatctgagtgaggtgttggtgggaggtcgcgcagattatgtcgccaccaccaaaaccagtgcattcagctctgagattcaaatcagcgtagttgcggagtgttcattcaagtccgtggctggcatggacgtatcagccaagtacaaggagcttatccagaaattccaagagaacagctccactagtctgtacgccatcggtgggaccacaatctccagcatcacagacaaagacacttacaatgcatggctcagttcgattgatacacgtcccgtcttctgtggattcacttacgaaagtcttcagcccatttgggaactcgctgaatcccctcagcgccaggagatcctgcaaaaggctacgaagacctttattccgcccgaaatcaaacgaaatgcaatcgtcgacgtagatattatcgtgtccgacaactatggggtgaatcctccctacagctatacgaagatcgattatgatctgaaccacaatgccaagggcaaatttatctttttgtgctacaatcaacagaagatatcagtagcaggatcccctgcggatccgaagcccatcactgccttgtacgtggcttctggcgatgacgatcatccatacgttcctccaggctataccaggatcagcagcgatctgaacgagggtgcggggggcaaatttatctatctatgctacacaaaagatccggctgcaatacccagcgacgaggatggactgcccatacgtggcatccgcgttattggtaacgaaaatatcgacaatgtggttacaccttacggattcacgaagattgataaagatctgaacgagggtgcagggggagactttatctacgttcgtttctcacctcatttagac

SEQ ID NO: 10 - protein, 451 aa, Lycopodium nummulariifolium
MARIEPLPGSDAIGHSYDVFGFYANPRSVNTQLFDFAPQQEIILEDHKWLLSTDIEYIAVRETEIKTVSLRTKDAYSTELAASVKVSGSYGSFSASVESDFSQSISDETDSTYTSVRTNVNKWKLSLKPTVEELRSMLTPSFKEALASMDLEELFTTYGTHYLSEVLVGGRADYVATTKTSAFSSEIQISVVAECSFKSVAGMDVSAKYKELIQKFQENSSTSLYAIGGTTISSITDKDTYNAWLSSIDTRPVFCGFTYESLQPIWELAESPQRQEILQKATKTFIPPEIKRNAIVDVDIIVSDNYGVNPPYSYTKIDYDLNHNAKGKFIFLCYNQQKISVAGSPADPKPITALYVASGDDDHPYVPPGYTRISSDLNEGAGGKFIYLCYTKDPAAIPSDEDGLPIRGIRVIGNENIDNVVTPYGFTKIDKDLNEGAGGDFIYVRFSPHLD

SEQ ID NO: 11 - DNA, 1353 bp, Lycopodium nummulariifolium
atggcccgtatcgagccattacctggatcggatgcaatcggacacagttatgatgtattcggattttacgccaaccccaagagcgttaatacacagctcttcgactttgcccctcagcaagaaattattttagaggaccacaaatggctcctctccactgatattgaatatattgctgtccgagatacggaaataaaaaccgtctctcttcgtacaaaagatgcatactccacggagctggctgcaagcgtaaaagtgtccggcagctatggcagcttctcggcttcggtagagtctgatttctcccaaagcatcagcgatgagactgattccacttacacttctgttcgtacaaatgtgaacaagtggaagctcagtctgaagccaactgtggaagaactgcgttccatgttgacaccttcgttcaaggaagctttggcgagtatggactcggaggagctgtttacgacgtacgggacacattatctgagtgaggtgttggtgggaggtcgcgcagattatgtcgccaccaccaaaaccagtgcattcagctctgatattcaaatcagcgtaggtgcggagtgttcattcaagtccgtggttggcatggacgtatcagccaagtacaaggagcttatccagaaattccaagagaacagctccactagtctgtacgccatcggtgggaccgaaatctccagcatcacagacacggacacttacaatgcatggctcagttcgattgatacacgtcccgtcttctgtggattcacttacgaaagtcttcagcccatttgggaactcgctgaatcccctcagcgccaggagatcctccaaaaggctacgaagacctttatttcgcccgaaatcaaacgcaatgcaatcgtcgacgtagatattatcgtgtccgacaactatggggtgaatcctccctacggctatacgaagatcgattatgatctgaaccgcaatgccaagggcaaatttatctttttgtgctacaatcaacagaagatatcagtagcaggatcccctgcggatccgaagcccatcactgctttgtacgtggcttctggcgatgacgatcatccatacgttcctccaggctataccaggatcagcagcgatctgaacgagggtgcggggggcaaatttatctatctatgctacacaaaagatccggctgcaatacccagcgacgaggatggactgcccatacgtggcatccgcgttattggtaacgaaaatatcgagaatgtggttacaccttacggattcacgaagattgataaagatctgaacgagggtgcagggggagactttatcttcgttcgtttctcacctcatttagac

SEQ ID NO: 12 - protein, 451 aa, Lycopodium nummulariifolium
MARIEPLPGSDAIGHSYDVFGFYANPKSVNTQLFDFAPQQEIILEDHKWLLSTDIEYIAVRDTEIKTVSLRTKDAYSTELAASVKVSGSYGSFSASVESDFSQSISDETDSTYTSVRTNVNKWKLSLKPTVEELRSMLTPSFKEALASMDSEELFTTYGTHYLSEVLVGGRADYVATTKTSAFSSDIQISVGAECSFKSVVGMDVSAKYKELIQKFQENSSTSLYAIGGTEISSITDTDTYNAWLSSIDTRPVFCGFTYESLQPIWELAESPQRQEILQKATKTFISPEIKRNAIVDVDIIVSDNYGVNPPYGYTKIDYDLNRNAKGKFIFLCYNQQKISVAGSPADPKPITALYVASGDDDHPYVPPGYTRISSDLNEGAGGKFIYLCYTKDPAAIPSDEDGLPIRGIRVIGNENIENVVTPYGFTKIDKDLNEGAGGDFIFVRFSPHLD

SEQ ID NO: 13 - DNA, 1353 bp, Lycopodium nummulariifolium
atggcccgtatcgagccattacctggatcggatgcaatcggacacagttatgatgtattcggattttacgccaaccccaagagcgttaatacacagctcttcgactttgcccctcagcaagaaattattttagaggaccacaaatggctcctctccactgatattgaatatattgctgtccgagatacggaaataaaaaccgtctctcttcgtacaaaagatgcatactccacggagctggctgcaagcgtaaaagtatccggcagctatggcagcttctcggcttcggtagagtctgatttctcccaaagcatcagcgatgagactgattccacttacacttctgttcgtacaaatgtgaacaagtggaagctcagtctgaagccaactgtggaagaactgcgttccatgttgacaccttcgttcaaggaagctttggcgagtatggactcggaggagctgtttacgacgtacgggacacattatctgagtgaggtgttggtgggaggtcgcgcagattatgtcgccaccaccaaaaccagtgcattcagctctgatattcaaatcagcgtagttgcggagtgttcattcaagtccgtggctggcatggacgtatcagccaagtacaaggagcttatccagaaattccaagagaacagctccactagtctgtacgccatcggtgggaccacaatctccagcatcacagacaaagacacttacaatgcatggctcagttcgattgatacacgtcccgtcttctgtggattcacttacgaaagtcttcagcccatttgggaacttgctgaatcccctcagcgccaggagatcctgcaaaaggctacgaagacctttatttcgcccgaaatcaaacgaaatgcaatcgtcgacgtagatattatcgtgtccgacaactatggggtgaatcctccctacggctatacgaagatcgattatgatctgaaccacaatgccaagggcaaatttatctttttgtgctacaatcaacagaagatatcagtagcaggatcccctgcggatccgaagcccatcactgttttgtacgtggcttctggcgatgacgatcatccatacgttcctccaggctataccaggatcagcagcgatctgaacgagggtgcggggggcaaatttatctatctatgctacacaaaagatccggctgcaatacccagcgacgaggatggactgcccatacgtggcatccgcgttattggtaacgaaaatatcgacaatgtggttacaccttacggattcacgaagattgataaagatctgaacgagggtgcagggggagactttatcttcgttcgtttctcacctcatttagac

SEQ ID NO: 14 - protein, 451 aa, Lycopodium nummulariifolium
MARIEPLPGSDAIGHSYDVFGFYANPKSVNTQLFDFAPQQEIILEDHKWLLSTDIEYIAVRDTEIKTVSLRTKDAYSTELAASVKVSGSYGSFSASVESDFSQSISDETDSTYTSVRTNVNKWKLSLKPTVEELRSMLTPSFKEALASMDSEELFTTYGTHYLSEVLVGGRADYVATTKTSAFSSDIQISVVAECSFKSVAGMDVSAKYKELIQKFQENSSTSLYAIGGTTISSITDKDTYNAWLSSIDTRPVFCGFTYESLQPIWELAESPQRQEILQKATKTFISPEIKRNAIVDVDIIVSDNYGVNPPYGYTKIDYDLNHNAKGKFIFLCYNQQKISVAGSPADPKPITVLYVASGDDDHPYVPPGYTRISSDLNEGAGGKFIYLCYTKDPAAIPSDEDGLPIRGIRVIGNENIDNVVTPYGFTKIDKDLNEGAGGDFIFVRFSPHLD

SEQ ID NO: 15 - DNA, 1353 bp, Lycopodium nummulariifolium
atggcccgtatcgagccattacctggatcggatgcaatcggacacagttatgatgtattcggattttacgccaaccccaggagcgttaatacacagctcttcgactttgcccctcagcaagaaattattttagaggaccacaaatggctcctctccactgatattgaatatattgctgtccgagaaaccgaaataaaaaccgtctctcttcgtacaaaagatgcatactccacggagctggctgcaagcgtaaaagtgtccggcagctatggcagcttctcggcttcggtagagtctgatttctcccaaagcatcagcgatgagacggattccacttacacttctgttcgtacaaatgtgaacaagtggaagctcagtctgaagccaactgtggaagaactgcgttccatgttgacaccttcgttcaaggaagctttggcgagtatggactcggaggagctgtttacgacgtacgggacacattatctgagtgaggtgttggtgggaggtcgcgcagattatgtcgccaccaccaaaaccagtgcattcagctctgatattcaaatcagcgtagttgcggagtgttcattcaagtccgtggctggcatggacgtatcagccaagtacaaggagcttatccagaaattccaagagaacagctccactagtctgtacgccatcggtgggaccacaatctccagcatcacagacaaagacacttacaatgcatggctcagttcgattgatacacgtcccgtcttctgtggattcacttacgaaagtcttcagcccatctgggaactcgctgaatcccctcagcgccaggagatcctccaaaaggctacgaagacctttattccgcccgaagtcagacgaaatgcgatcgtggacgtagagattaccgtgtccgacagctattgggtgaatcctccctacggctatacgaagatcgattatgatctgaaccgcaatgccaagggcaaatatatctttttgtgctacaatcaacagaagatatcagtagcaggatcccctgcggatccgaagcccatcactgccttgtacgtggcttctggcgatgacaataatccatacattcctccaggttataccaggatcaacagcgatctgaacgagggtgcggggggcaaatttatttatctatgctacacaaaagatccggctgcaatacccagcgacgaggatggactgcccatacgtggcatccgcgttattggtaacgaaaatggccagaatgtggttacaccttacggattcacgaagattgataaagatctgaacgagggtgcagggggagactatatcttcgttcgtttctcacctcatttagac

SEQ ID NO: 16 - protein, 451 aa, Lycopodium nummulariifolium
MARIEPLPGSDAIGHSYDVFGFYANPRSVNTQLFDFAPQQEIILEDHKWLLSTDIEYIAVRETEIKTVSLRTKDAYSTELAASVKVSGSYGSFSASVESDFSQSISDETDSTYTSVRTNVNKWKLSLKPTVEELRSMLTPSFKEALASMDSEELFTTYGTHYLSEVLVGGRADYVATTKTSAFSSDIQISVVAECSFKSVAGMDVSAKYKELIQKFQENSSTSLYAIGGTTISSITDKDTYNAWLSSIDTRPVFCGFTYESLQPIWELAESPQRQEILQKATKTFIPPEVRRNAIVDVEITVSDSYWVNPPYGYTKIDYDLNRNAKGKYIFLCYNQQKISVAGSPADPKPITALYVASGDDNNPYIPPGYTRINSDLNEGAGGKFIYLCYTKDPAAIPSDEDGLPIRGIRVIGNENGQNVVTPYGFTKIDKDLNEGAGGDYIFVRFSPHLD

SEQ ID NO: 17 - DNA, 1353 bp, Lycopodium nummulariifolium
atggcccgtatcgagccattacctggatcggatgcaatcggacacagttatgatgtattcggattttacgccaaccccaagagcgttaatagacagctcttcgactttgcccctcagcaagaaattattttagaggaccacaaatggctcctctccactgatattgaatatattgctgttcgagatacggaaataaaaaccgtctctcttcgtacaaaagatgcatactccacggagctggctgcaagcgtaaaagtgtccggcagctatggcagcttctcggcttcggtagagtctgatttctcccaaagcatcagcgatgagacggattccacttacacttctgttcgtacaaatgtgaacaagtggaagctcagtctgaagccaactgtggaagaactgcgttccatgttgacaccttcgttcaagcaagctttggcgagtatgaactcggaggagctgtttacgacgtacgggacacattatctgagtgaggttttggtgggaggtcgcgcagattatgtcgccaccaccaaaaccagtgcattcagctctgatattcaaatcagcgtaggtgcggagtgttcattcaagtccgtggctggcatggacgtatcagccaagtacaaggagcttatccagaaattccaagagaacagctccactagtctgtacgccatcggtgggaccgcaatctccagcatcacagacacggacacttacaatgcatggctcagttcgattgatacacgtcccgtcttctgtggattcacttacgaaagtcttcagcccatttgggaactcgctgaatcccctcaacgccaggagatcctccaaaaggctacgaagacctttatttcgcccgaaatcaaacgcaatgcaatcgtcgacgtagatattatcgtgtccgacaactatggggtgaatcctccctacggctatacgaagatcgattatgatctgaaccgcaatgccaagggcaaatttatctttttgtgctacaatcaacagaagatatcagtagcaggatcccctgcggatccgaagcccatcactgctttgtacgtggcttctggcgatgacgatcatccatacgttcctccaggctataccaggatcagcagcgatctgaacgagggtgcggggggcaaatttatctatctatgctacacaaaagatccggctgcaatacccagcgacgaggatggactgcccatacgtggcatccgcgttattggtaacgaaaatatcgacaatgtggttacaccttacggattcacgaagattgataaagatctgaacgagggtgcagggggagactttatctacgttcgtttctcacctcatttagac

SEQ ID NO: 18 - protein, 451 aa, Lycopodium nummulariifolium
MARIEPLPGSDAIGHSYDVFGFYANPKSVNRQLFDFAPQQEIILEDHKWLLSTDIEYIAVRDTEIKTVSLRTKDAYSTELAASVKVSGSYGSFSASVESDFSQSISDETDSTYTSVRTNVNKWKLSLKPTVEELRSMLTPSFKQALASMNSEELFTTYGTHYLSEVLVGGRADYVATTKTSAFSSDIQISVGAECSFKSVAGMDVSAKYKELIQKFQENSSTSLYAIGGTAISSITDTDTYNAWLSSIDTRPVFCGFTYESLQPIWELAESPQRQEILQKATKTFISPEIKRNAIVDVDIIVSDNYGVNPPYGYTKIDYDLNRNAKGKFIFLCYNQQKISVAGSPADPKPITALYVASGDDDHPYVPPGYTRISSDLNEGAGGKFIYLCYTKDPAAIPSDEDGLPIRGIRVIGNENIDNVVTPYGFTKIDKDLNEGAGGDFIYVRFSPHLD

SEQ ID NO: 19 - DNA, 1353 bp, Lycopodium nummulariifolium
atggcccgtatcgagccattacctggatcggatgcaatcggacacagttatgatgtattcggattttacgccaaccccaagagcgttaatagacagctcttcgactttgcccctcagcaagaaattattttagaggaccacaaatggctcctctccactgatattgaatatattgctgttcgagatacggaaataaaaaccgtctctcttcgtacaaaagatgcatactccacggagctggctgcaagcgtaaaagtgtccggcagctatggcagcttctcggcttcggtagagtctgatttctcccaaagcatcagcgatgagacggattccacttacacttctgttcgtacaaatgtgaacaagtggaagctcagtctgaagccaactgtggaagaactgcgttccatgttgacaccttcgttcaagcaagctttggcgagtatgaactcggaggagctgtttacgacgtacgggacacattatctgagtgaggttttggtgggaggtcgcgcagattatgtcgccaccaccaaaaccagtgcattcagctctgatattcaaatcagcgtaggtgcggagtgttcattcaagtccgtggctggcatggacgtatcagccaagtacaaggagcttatccagaaattccaagagaacagctccactagtctgtacgccatcggtgggaccgcaatctccagcatcacagacacggacacttacaatgcatggctcagttcgattgatacacgtcccgtcttctgtggattcacttacgaaagtcttcagcccatttgggaactcgctgaatcccctcaacgccaggagatcctccaaaaggctacgaagacctttatttcgcccgaaatcaaacgaaatgcaatcgtcgacgtagatattatcgtgtccgacaactatggggtgaatcctccctacggctatacgaagatcgattatgatctgaaccgcaatgccaagggcaaatttatctttttgtgctacaatcaacagaagatatcagtagcaggatcccctgcggatccgaagcccatcactgttttgtacgtggcttctggcgatgacgatcatccatacgttcctccaggttacaccaggatcagcagcgatctgaacgagggtgcggggggcaaatttatctatctatgctacacaaaagatccggctgcaatacccatcgacgaggatggactgcccatacgtggcatccgcgttattggtaacgaaaatatcgagaatgtggttacaccttacggattcacaacgattgataaagatctgaacgagggtgcagggggagactttatcttcgttcgtttctcacctcatttagac

SEQ ID NO: 20 - protein, 451 aa, Lycopodium nummulariifolium
MARIEPLPGSDAIGHSYDVFGFYANPKSVNRQLFDFAPQQEIILEDHKWLLSTDIEYIAVRDTEIKTVSLRTKDAYSTELAASVKVSGSYGSFSASVESDFSQSISDETDSTYTSVRTNVNKWKLSLKPTVEELRSMLTPSFKQALASMNSEELFTTYGTHYLSEVLVGGRADYVATTKTSAFSSDIQISVGAECSFKSVAGMDVSAKYKELIQKFQENSSTSLYAIGGTAISSITDTDTYNAWLSSIDTRPVFCGFTYESLQPIWELAESPQRQEILQKATKTFISPEIKRNAIVDVDIIVSDNYGVNPPYGYTKIDYDLNRNAKGKFIFLCYNQQKISVAGSPADPKPITVLYVASGDDDHPYVPPGYTRISSDLNEGAGGKFIYLCYTKDPAAIPIDEDGLPIRGIRVIGNENIENVVTPYGFTTIDKDLNEGAGGDFIFVRFSPHLD

SEQ ID NO: 21 - DNA, 1353 bp, Lycopodium nummulariifolium
atggcccgtatcgagccattacctggatcggatgcaatcggacacagttatgatgtattcggattttacgccaaccccaagagcgttaatagacagctcttcgactttgcccctcagcaagaaattgttttagaggaccacaaatggctcctctccactgatattgaatatattgctgttcgagatacggaaataaaaaccgtctctcttcgtacaaaagatgcatactccacggagctggctgcaagcgtaaaagtgtccggcagctatggcagcttctcggcttcggtagagtctgatttctcccaaagcatcagcgatgagacggattccacttacacttctgttcgtacaaatgtgaacaagtggaagctcagtctgaagccaactgtggaagaactgcgttccatgttgacaccttcgttcaagcaagctttggcgagtatgaactcggaggagctgtttacgacgtacgggacacattatctgagtgaggttttggtgggaggtcgcgcagattatgtcgccaccaccaaaaccagtgcattcagctctgatattcaaatcagcgtaggtgcggagtgttcattcaagtccgtggctggcatggacgtatcagccaagtacaaggagcttatccagaaattccaagagaacagctccactagtctgtacgccatcggtgggaccgcaatctccagcatcacagacacggacacttacaatgcatggctcagttcgattgatacacgtcccgtcttctgtggattcacttacgaaagtcttcagcccatttgggaactcgctgaatcccctcaacgccaggagatcctccaaaaggctacgaagacctttatttcgcccgaaatcaaacgaaatgcaatcgtcgacgtagatattatcgtgtccgacaactatggggtgaatcctccctacggctatacgaagatcgattatgatctgaaccgcaatgccaagggcaaatttatctttttgtgctacaatcaacagaagatatcagtagcaggatcccctgcggatccgaagcccatcactgctttgtacgtggcttctggcgatgacgatcatccatacgttcctccaggctataccaggatcagcagcgatctgaacgagggtgcggggggcaaatttatctatctatgctacacaaaagatccggctgcaatacccagcgacgaggatggactgcccatacgtggcatccgcgttattggtaacgaaaatatcgacaatgtggttacaccttacggattcacgaagattgataaagatctgaacgagggtgcagggggagactttatctacgttcgtttctcacctcatttagac

SEQ ID NO: 22 - protein, 451 aa, Lycopodium nummulariifolium
MARIEPLPGSDAIGHSYDVFGFYANPKSVNRQLFDFAPQQEIVLEDHKWLLSTDIEYIAVRDTEIKTVSLRTKDAYSTELAASVKVSGSYGSFSASVESDFSQSISDETDSTYTSVRTNVNKWKLSLKPTVEELRSMLTPSFKQALASMNSEELFTTYGTHYLSEVLVGGRADYVATTKTSAFSSDIQISVGAECSFKSVAGMDVSAKYKELIQKFQENSSTSLYAIGGTAISSITDTDTYNAWLSSIDTRPVFCGFTYESLQPIWELAESPQRQEILQKATKTFISPEIKRNAIVDVDIIVSDNYGVNPPYGYTKIDYDLNRNAKGKFIFLCYNQQKISVAGSPADPKPITALYVASGDDDHPYVPPGYTRISSDLNEGAGGKFIYLCYTKDPAAIPSDEDGLPIRGIRVIGNENIDNVVTPYGFTKIDKDLNEGAGGDFIYVRFSPHLD

SEQ ID NO: 23 - DNA, 1353 bp, Lycopodium nummulariifolium
atggcccgtatcgagccattacctggatcggatgcaatcggacacagttatgatgtattcggattttacgccaaccccaggagcgttaatacacagctcttcgactttgcccctcagcaagaaattattttagaggaccacaaatggctcctctccactgatattgaatatattgctgtccgagaaaccgaaataaaaaccgtctctcttcgtacaaaagatgcatactccacggagctggctgcaagcgtaaaagtgtccggcagctatggcagcttctcggcttcggtagagtctgatttctcccaaagcatcagcgatgagacggattccacttacacttctgttcgtacaaatgtgaacaagtggaagctcagtctgaagccaactgtggaagaactgcgttccatgttgacaccttcgttcaaggaagctttggcgagtatggactcggaggagctgtttacgacgtacgggacacattatctgagtgaggtgttggtgggaggtcgcgcagattatgtcgccaccaccaaaaccagtgcattcagctctgatattcaaatcagcgtagttgcggagtgttcattcaagtccgtggctggcatggacgtatcagccaagtacaaggagcttatccagaaattccaagagaacagctctactagtctgtacgccatcggtgggaccacaatctccagcatcacagacaaagacacttacaatgcatggctcagttcgattgatacacgtcccgtcttctgtggattcacttacgaaagtcttcagcccatttgggaactcgctgaatcccctcagcgccaggagatcctccaaaaggctacgaagacctttatttcgcccgaaatcaaacgaaatgcaatcgtcgacgtagatattatcgtgtccgacaactatggggtgaatcctccctacggctatacgaagatcgattatgatctgaaccgcggtgccaagggcaaatttatctatttatgctacaagcaacagaagatatcagtagcaggatcccctgcggatccgaaacccatcactgccttgaacgtggtttctagcgattaccatgatccatccggtccttcaggttataccatgatctacacagatctgaaccagggtgtggggggcaagtttatctatctctgctacacaaaagatccagctgcaatacccagcgacgaagatggactgcccatacgtggcatccgcgttattggtaacccacagttcgggaatgtggttacaccttacggattcacgaggattgataaagatctgaatgagggtgcaaagggagagtttatctacgttcgtttctcacctcatttagac

SEQ ID NO: 24 - protein, 451 aa, Lycopodium nummulariifolium
MARIEPLPGSDAIGHSYDVFGFYANPRSVNTQLFDFAPQQEIILEDHKWLLSTDIEYIAVRETEIKTVSLRTKDAYSTELAASVKVSGSYGSFSASVESDFSQSISDETDSTYTSVRTNVNKWKLSLKPTVEELRSMLTPSFKEALASMDSEELFTTYGTHYLSEVLVGGRADYVATTKTSAFSSDIQISVVAECSFKSVAGMDVSAKYKELIQKFQENSSTSLYAIGGTTISSITDKDTYNAWLSSIDTRPVFCGFTYESLQPIWELAESPQRQEILQKATKTFISPEIKRNAIVDVDIIVSDNYGVNPPYGYTKIDYDLNRGAKGKFIYLCYKQQKISVAGSPADPKPITALNVVSSDYHDPSGPSGYTMIYTDLNQGVGGKFIYLCYTKDPAAIPSDEDGLPIRGIRVIGNPQFGNVVTPYGFTRIDKDLNEGAKGEFIYVRFSPHLD

SEQ ID NO: 25 - DNA, 1353 bp, Lycopodium nummulariifolium
atggcccgtatcgagccattacctggatcggatgcaatcggacacagttatgatgtattcggattttacgccaaccccaagagcgttaatacacagctcttcgaccttgcccctcagcaagaaattattttagaggaccacaaatggctcctctccactgatattgaatatattgctgtccgagaaaccgaaataaaaaccgtctctcttcgtacaaaggatgcatactccacggagctggctgcaagcgtaaaagtgtccggcagctatggcagcttctcggcttcgatagagtctgatttctcccaaagcatcagcgatgagactgattccacttacacttctgttcgtacaaatgtgaacaagtggaagctcagtctgaagccaactgtggaagaactgcgttccatgttgacaccttcgttcaaggaagctttggcgagtatagactcggaggagctgtttacgacgtacgggacacattatctgagtgaggtgttggtgggaggtcgcgcagattatgtcgccaccaccaaaaccagtgcattcagctctgatattcaaatcagcgtagttgcggagtgttcattcaagtccgtggctggcatggacgtatcagccaagtacaaggagcttatccagaaattccaagagaacagctccactagtctgtacgccatcggtgggaccacaatctccagcatcacagacaaagacacttacaatgcatggctcagttcgattgatacacgtcccgtcttctgtggattcacttacgaaagtcttcagcccatttgggaacttgctgaatcccctcagcgccaggagatcctgcaaaaggctacgaagacctttatttcgcccgaaatcaaacgaaatgcaatcgtcgacgtagatattatcgtgtccgacaactatggggtgaatcctccctacggctatacgaagatcgattatgatctgaaccgcaatgccaagggcaaatttatctttttgtgctacaatcaacagaagatatcagtagcaggatcccctgcggatccgaagcccatcactgttttgtacgtggcttctggcgatgacgatcatccatacgttcctccaggttacaccaggatcagcagcgatctgaacgagggtgcggggggcaaatttatctatctatgctacacaaaagatccggctgcaatacccatcgacgaggatggactgcccatacgtggcatccgcgttattggtaacgaaaatatcgagaatgtggttacaccttacggattcacaacgattgataaagatctgaacgagggtgcagggggagactttatcttcgttcgtttctcacctcatttagac

SEQ ID NO: 26 - protein, 451 aa, Lycopodium nummulariifolium
MARIEPLPGSDAIGHSYDVFGFYANPKSVNTQLFDLAPQQEIILEDHKWLLSTDIEYIAVRETEIKTVSLRTKDAYSTELAASVKVSGSYGSFSASIESDFSQSISDETDSTYTSVRTNVNKWKLSLKPTVEELRSMLTPSFKEALASIDSEELFTTYGTHYLSEVLVGGRADYVATTKTSAFSSDIQISVVAECSFKSVAGMDVSAKYKELIQKFQENSSTSLYAIGGTTISSITDKDTYNAWLSSIDTRPVFCGFTYESLQPIWELAESPQRQEILQKATKTFISPEIKRNAIVDVDIIVSDNYGVNPPYGYTKIDYDLNRNAKGKFIFLCYNQQKISVAGSPADPKPITVLYVASGDDDHPYVPPGYTRISSDLNEGAGGKFIYLCYTKDPAAIPIDEDGLPIRGIRVIGNENIENVVTPYGFTTIDKDLNEGAGGDFIFVRFSPHLD

SEQ ID NO: 27 - DNA, 1353 bp, Lycopodium nummulariifolium
atggcccgtatcgagccattacctggatcggatgcaatcggacacagttatgatgtattcggattttacgccaaccccaagagcgttaatacacagctcttcgactttgcccctcagcaagaaattattttagaggaccacaaatggctcctctccactgatattgaatatattgctgttcgagatacggaaataaaaaccgtctctcttcgtacaaaagatgcatactccacggagctggctgcgagcgtaaaagtgtccggcagctatggcagcttctcggcttcggtagagtctgatttctcccaaagcatcagcgatgagacggattccacttacacttctgttcgtacaaatgtgaacaagtggaagctcagtctgaagccaactgtggaagaactgcgttctatgttgacaccttcgttcaaggaagctttggcgagtatggactcggaggagctgtttacgacgtacgggacacattatctgagtgaggtgttggtgggaggtcgcgcagattatgtcgccaccaccaaaaccagtgcattcagctctgatattcaaatcagcgtagttgcggagtgttcattcaagtccgtggctggcatggacgtatcagccaagtacaaggagcttatccagaaattccaagagaacagctccactagtctgtacgccatcggtgggaccacaatctccagcatcacagacaaagacacttacaatgcatggctcagttcgattgatacacgtcccgtcttctgtggattcacttacgaaagtcttcagcccatttgggaactcgctgaatcccctcagcgccaggagatcctgcaaaaggctacgaagacctttattccgcccgaaatcaaacgaaatgcaatcgtcgacgtagatattatcgtgtccgacaactatggggtgaatcctccctacggctatacgaagatcgattatgatctgaaccgcaatgccaagggcaaatttatctttttgtgctacaatcaacagaagatatcagtagcaggatcccctgcggatccgaagcccatcactgctttgtacgtggcttctggcgatgacgatcatccatacgttcctccaggttacaccaggatcagcagcgatctgaacgagggtgcggggggcaaatttatctatctatgctacacaaaagatccggctgcaatacccagcgacgaggatggactgcccatacgtggcatctgcgttattggtaacgaaaatatcgagaatgtggttacaccttacggattcacgaagattgataaagatctgaacgagggtgcagggggagactttatcttcgttcgtttctcacctcatttagac

SEQ ID NO: 28 - protein, 451 aa, Lycopodium nummulariifolium
MARIEPLPGSDAIGHSYDVFGFYANPKSVNTQLFDFAPQQEIILEDHKWLLSTDIEYIAVRDTEIKTVSLRTKDAYSTELAASVKVSGSYGSFSASVESDFSQSISDETDSTYTSVRTNVNKWKLSLKPTVEELRSMLTPSFKEALASMDSEELFTTYGTHYLSEVLVGGRADYVATTKTSAFSSDIQISVVAECSFKSVAGMDVSAKYKELIQKFQENSSTSLYAIGGTTISSITDKDTYNAWLSSIDTRPVFCGFTYESLQPIWELAESPQRQEILQKATKTFIPPEIKRNAIVDVDIIVSDNYGVNPPYGYTKIDYDLNRNAKGKFIFLCYNQQKISVAGSPADPKPITALYVASGDDDHPYVPPGYTRISSDLNEGAGGKFIYLCYTKDPAAIPSDEDGLPIRGICVIGNENIENVVTPYGFTKIDKDLNEGAGGDFIFVRFSPHLD

SEQ ID NO: 29 - DNA, 1353 bp, Lycopodium nummulariifolium
atggtccgtatcgagccattacctggatcggatgcaatcggacacagttatgatgtattcggattttacgccaaccccaagagcgttaatacacagctcttcgactttgcccctcaggaagaaattattttagaggaccacaaatggctcctctccactgatattgaatatattgctgtccgagatacggaaataaaaaccgtctctcttcgtacaaaagatgcatactccacggagctggctgcaagcgtaaaagtgtccggcagctatggcagcttctcggcttcggtagagtctgatttctcccaaagcatcagcgatgagactgattccacttacacttctgttcgtacaaatgtgaacaagtggaagctcagtctgaagccaactgtggaagaactgcgttccatgttgacaccttcgttcaaggaagctttggcgagtatggactcggaggagctgtttacgacgtacgggacacattatctgagtgaggtgttggtgggaggtcgcgcagattatgtcgccaccaccaaaaccagtgcattcagctctgatattcaaatcagcgtagttgcggagtgttcattcaagtccgtggctggcatggacgtatcagccaagtacaaggagcttatccagaaattccaagagaacagctccactagtctgtacgccatcggtgggaccacaatctccagcatcacagacaaagacacttacaatgcatggctcagttcgattgatacacgtcccgtcttctgtggattcacttacgaaagtcttcagcccatttgggaactcgctgaatcccctcagcgccaggagatcctgcaaaacgctacgaagacctttattccacccgaaatcaaacgaaatgcaatcgtcgacgtagatattatcgtgtccgacaactatggggtgaatcctccctacggctatacgaagatcgattatgatctgaaccacaatgccaagggcaaatttatctttttgtgctacaatcaacagaagatatcagtagcaggatcccctgcggatccgaagcccatcactgccttgtacgtggcttctggcgatgacgatcatccatacgttcctccaggctataccaggatcagcagcgatctgaacgagggtgcggggggcaaatttatctatctatgctacacaaaagatccggctgcaatacccagcgacgaggatggactgcccatacgtggcatccgcgttattggtaacgaaaatatcgacaatgtggttacaccttacggattcacgaagattgataaagatctgaacgagggtgcagggggggactttatcttcgttcgtttctcacctcatttagac

SEQ ID NO: 30 - protein, 451 aa, Lycopodium nummulariifolium
MVRIEPLPGSDAIGHSYDVFGFYANPKSVNTQLFDFAPQEEIILEDHKWLLSTDIEYIAVRDTEIKTVSLRTKDAYSTELAASVKVSGSYGSFSASVESDFSQSISDETDSTYTSVRTNVNKWKLSLKPTVEELRSMLTPSFKEALASMDSEELFTTYGTHYLSEVLVGGRADYVATTKTSAFSSDIQISVVAECSFKSVAGMDVSAKYKELIQKFQENSSTSLYAIGGTTISSITDKDTYNAWLSSIDTRPVFCGFTYESLQPIWELAESPQRQEILQNATKTFIPPEIKRNAIVDVDIIVSDNYGVNPPYGYTKIDYDLNHNAKGKFIFLCYNQQKISVAGSPADPKPITALYVASGDDDHPYVPPGYTRISSDLNEGAGGKFIYLCYTKDPAAIPSDEDGLPIRGIRVIGNENIDNVVTPYGFTKIDKDLNEGAGGDFIFVRFSPHLD

SEQ ID NO: 31 - DNA, 1353 bp, Lycopodium nummulariifolium
atggcccgtatcgagccattacctggatcggatgcaatcggacacagttatgatgtattcggattttacgccaaccccaagagcgttaatacacagctcttcgactttgcccctcagcaagaaattattttagaggaccacaaatggctcctctccactgatattgaatatattgctgttcgagatacggaaataaaaaccgtctctcttcgtacaaaagatgcatactccacggagctggctgcgagcgtaaaagtgtccggcagctatggcagcttctcggcttcggtagagtctgatttttcccaaagcatcagcgatgagacggattccacttacacttctattcgtacaaatgtgaacaagtggaagctcagtctgaagccaactgtggaagaactgcgttccatgttgacaccttcgttcaagcaagctttggcgagtatgaactcggaggagctgtttacgacgtacgggacacattatctgagtgaggttttggtgggtggtcgcgcagattatgtcgccaccaccaaaaccagtgcattcagctctgatattcaaatcagcgtaggtgcggagtgttcattcaagtccgtggttggcatggacgtatcagccaagtacaaggagcttatccagaaattccaagagaacagctccactagtctgtacgccatcggtgggaccgcaatctccagcatcacagacacggacacttacaatgcatggctcagttcgattgatacacgtcccgtcttctgtggattcacttacgaaagtcttcagcccatttgggaactcgctgaatcccctcagcgccaggagatcctccaaaaggctacgaagacctttatttcgcccgaaatcaaacgcaatgcaatcgtcgacgtagatattatcgtgtccgacaactatggggtgaatcctccctacggctatacgaagatcgattatgatctgaaccgcaatgccaagggcaaatttatctttttgtgctacaatcaacagaagatatcagtagcaggatcccctgcggatccgaagcccatcactgctttgtacgtggcttctggcgatgacgatcatccatacgttcctccaggctataccaggatcagcagcgatctgaacgagggtgcggggggcaaatttatctatctatgctacacaaaagatccggctgcaatacccagcgacgaggatggactgcccatacgtggcatccgcgttattggtaacgaaaatatcgagaatgtggttacaccttacggattcacgaagattgataaagatctgaacgagggtgcagggggagactttatcttcgttcgtttctcacctcatttagac

SEQ ID NO: 32 - protein, 451 aa, Lycopodium nummulariifolium
MARIEPLPGSDAIGHSYDVFGFYANPKSVNTQLFDFAPQQEIILEDHKWLLSTDIEYIAVRDTEIKTVSLRTKDAYSTELAASVKVSGSYGSFSASVESDFSQSISDETDSTYTSIRTNVNKWKLSLKPTVEELRSMLTPSFKQALASMNSEELFTTYGTHYLSEVLVGGRADYVATTKTSAFSSDIQISVGAECSFKSVVGMDVSAKYKELIQKFQENSSTSLYAIGGTAISSITDTDTYNAWLSSIDTRPVFCGFTYESLQPIWELAESPQRQEILQKATKTFISPEIKRNAIVDVDIIVSDNYGVNPPYGYTKIDYDLNRNAKGKFIFLCYNQQKISVAGSPADPKPITALYVASGDDDHPYVPPGYTRISSDLNEGAGGKFIYLCYTKDPAAIPSDEDGLPIRGIRVIGNENIENVVTPYGFTKIDKDLNEGAGGDFIFVRFSPHLD

SEQ ID NO: 33 - DNA, 1353 bp, Lycopodium nummulariifolium
atggcccgtatcgagccattacctggatcggatgcaatcggacacagttatgatgtgttcggattttatgccaatccaaagagcgtgaagaaagagctcttcgactttgccctccagaaagaaatcactttagagggccacacttggctcctttccactgatattgaatatattgcagttcgagatacggaaataaaaaccgtctctcttcgcacaaaagatgcatactcaagcgagctggctgcaagcgtaaaactgtccggcagctatggcggattctcagcgtcggtagaatctgacttctcccaaagcatcagcgatgagacggattccacttacacttcagttcgtacaaatgtgaacaagtggaagctcagtctgaagcacactgtggaagagctacgctccaagttgaagcctgcgttgaaggaggcgttggcgaatatgaaagaagtggagctgttgagtacgtacgggacacattatatgggcgaggtgttggtgggaggtcgtgcagattatttggccaccaccaaaaccagtgcattcagctcggacactaaaatcagcacagtagcggagagttctttcaagtccgtagctggcatgaaagtatccgcggagcaaaagcagcttatcgaaaaattccaagaaaacagctccaccagtctgtacgccatcggtgggagcgcactctccagcatcacagacacggccacttacaacgcatggctcagttcgattgatacacgtcccgtcttctgtggattcactcgcgacagtcttaggcccatctgggagctcgctgaatcccctcagcgccgggagattctccgaaaagctacccaaacgtttatcccaccagaaatcacacgaaatgcagtcgttggcgtagatattatcatgtctgaaaactattgggtgaatcctccgtacggctatacgaagatcgattacgatctgaatcgcaatgccaagggcaaatatatcttcttgtgttacaaacaacagaagatatcagtagctggatccccagcggatcccaagcccatcactgccttgtacgtggcttctggcgatgatgataatccatatgttcctccaggttacaccaagatcgaccaagatctgaacaaggatgctgggggcaagtttatctatctctcttacacaaaagatccagctgcaatacccaacgacgaggatggactgcccatacgtggcatccgcgttatcggcaatgaaaagcttgagaatgtggttacaccgtacggattcacgaggattgatgaagatctgaataaggatgcaaagggagactatatcttcgttcgtttctcacctcatttagac

SEQ ID NO: 34 - protein, 451 aa, Lycopodium nummulariifolium
MARIEPLPGSDAIGHSYDVFGFYANPKSVKKELFDFALQKEITLEGHTWLLSTDIEYIAVRDTEIKTVSLRTKDAYSSELAASVKLSGSYGGFSASVESDFSQSISDETDSTYTSVRTNVNKWKLSLKHTVEELRSKLKPALKEALANMKEVELLSTYGTHYMGEVLVGGRADYLATTKTSAFSSDTKISTVAESSFKSVAGMKVSAEQKQLIEKFQENSSTSLYAIGGSALSSITDTATYNAWLSSIDTRPVFCGFTRDSLRPIWELAESPQRREILRKATQTFIPPEITRNAVVGVDIIMSENYWVNPPYGYTKIDYDLNRNAKGKYIFLCYKQQKISVAGSPADPKPITALYVASGDDDNPYVPPGYTKIDQDLNKDAGGKFIYLSYTKDPAAIPNDEDGLPIRGIRVIGNEKLENVVTPYGFTRIDEDLNKDAKGDYIFVRFSPHLD

SEQ ID NO: 35 - DNA, 1353 bp, Lycopodium nummulariifolium
atggcccgtatcgagccattacctggatcggatgcaatcggacacagttatgatgtattcggattttacgccaaccccaagagcgttaatacacagctcttcgactttgcccctcagcaagaaattattttagaggaccacaaatggctcctctccactgatattgaatatattgctgtccgagatacggaaataaaaaccgtctctcttcgtacaaaggatgcatactccacggagctggctgcaagcgtaaaagtgtccggcagctatggcagcttctcggcttcggtagagtctgatttctcccaaagcatcagcgatgagactgattccacttatacttctgttcgtacaaatgtgaacaagtggaagctcagtctgaagccaactgtggaagaactgcgttctatgttgacaccttcgttcaaggaagctttggcgagtatggactcggaggagctgtttacgacgtacgggacacattatctgagtgaggtgttggtgggaggtcgcgcagattatgtcgccaccaccaaaaccagtgcattcagctctgatattcaaatcagcgtagttgcggagtgttcattcaagtccgtggctggcatggacgtatcagccaagtacaaggagcttatccagaaattccaagagaacagctccactagtctgtacgccatcggtgggaccacaatctccagcatcacagacaaagacacttacaatgcatggctcagttcgattgatacacgtcccgtcttctgtggattcacttacgaaagtcttcagcccatttgggaactcgctgaatcccctcagcgccaggagatcctgcaaaaggctacgaagacctttattccgcccgaaatcaaacgaaatgcaatcgtcgacgtagatattatcgtgtccgacaactatggggtgaatcctccctacagctatacgaagatcgattatgatctgaaccacaatgccaagggcaaatttatctttttgtgctacaatcaacagaagatatcagtagcaggatcccctgcggatccgaagcccatcactgccttgtacgtggcttctggcgatgacgatcatccatacgttcctccaggctataccaggatcagcagcgatctgaacgagggtgcggggggcaaatttatctatctatgctacacaaaagatccggctgcaatacccagcgacgaggatggactgcccatacgtggcatccgcgttattggtaacgaaaatatcgacaatgtggttacaccttacggattcacgaagattgataaagatctgaacgagggtgcagggggagactttatctacgttcgtttctcacctcatttagac

SEQ ID NO: 36 - protein, 451 aa, Lycopodium nummulariifolium
MARIEPLPGSDAIGHSYDVFGFYANPKSVNTQLFDFAPQQEIILEDHKWLLSTDIEYIAVRDTEIKTVSLRTKDAYSTELAASVKVSGSYGSFSASVESDFSQSISDETDSTYTSVRTNVNKWKLSLKPTVEELRSMLTPSFKEALASMDSEELFTTYGTHYLSEVLVGGRADYVATTKTSAFSSDIQISVVAECSFKSVAGMDVSAKYKELIQKFQENSSTSLYAIGGTTISSITDKDTYNAWLSSIDTRPVFCGFTYESLQPIWELAESPQRQEILQKATKTFIPPEIKRNAIVDVDIIVSDNYGVNPPYSYTKIDYDLNHNAKGKFIFLCYNQQKISVAGSPADPKPITALYVASGDDDHPYVPPGYTRISSDLNEGAGGKFIYLCYTKDPAAIPSDEDGLPIRGIRVIGNENIDNVVTPYGFTKIDKDLNEGAGGDFIYVRFSPHLD

SEQ ID NO: 37 - DNA, 1353 bp, Lycopodium nummulariifolium
atggcccgtatcgagccattacctggatcggatgcaatcggacacagttatgatgtattcggattttacgccaaccccaggagcgttaatacacagctcttcgactttgcccctcagcaagaaattattttagaggaccacaaatggctcctctccactgatattgaatatattgctgtccgagaaaccgaaataaaaaccgtctctcttcgtacaaaagatgcatactccacggagctggctgcaagcgtaaaagtgtccggcagctatggcagcttctcggcttcggtagagtctgatttctcccaaagcatcagcgatgagacggattccacttatacttctgttcgtacaaatgtgaacaagtggaagctcagtctgaagccaactgtggaagaactgcgttccatgttgacaccttcgttcaaggaagctttggcgagtatggacttggaggagctgtttacgacgtacgggacacattatctgagtgaggtgttggtgggaggtcgcgcagattatgtcgccaccaccaaaaccagtgcattcagctctgagattcaaatcagcgtagttgcggagtgttcattcaagtccgtggctggcatggacgtatcagccaagtacaaggagcttatccagaaattccaagagaacagctccactagtctgtacgccatcggtgggaccacaatctccagcatcacagacaaagacacttacaatgcatggctcagttcgattgatacacgtcccgtcttctgtggattcacttacgaaagtcttcagcccatttgggaactcgctgaatcccctcagcgccaggagatcctgcaaaaggctacgaagacctttattccgcccgaaatcaaacgaaatgcaatcgtcgacgtagatattatcgtgtccgacaactatggggtgaatcctccctacagctatacgaagatcgattatgatctgaaccacaatgccaagggcaaatttatctttttgtgctacaatcaacagaagatatcagtagcaggatcccctgcggatccgaagcccatcactgccttgtacgtggcttctggcgatgacgatcatccatacgttcctccaggctataccaggatcagcagcgatctgaacgagggtgcggggggcaaatttatctatctatgctacacaaaagatccggctgcaatacccagcgacgaggatggactgcccatacgtggcatccgcgttattggtaacgaaaatatcgacaatgtggttacaccttacggattcacgaagattgataaagatctgaacgagggtgcagggggagactttatcttcgttcgtttctcacctcatttagac

SEQ ID NO: 38 - protein, 451 aa, Lycopodium nummulariifolium
MARIEPLPGSDAIGHSYDVFGFYANPRSVNTQLFDFAPQQEIILEDHKWLLSTDIEYIAVRETEIKTVSLRTKDAYSTELAASVKVSGSYGSFSASVESDFSQSISDETDSTYTSVRTNVNKWKLSLKPTVEELRSMLTPSFKEALASMDLEELFTTYGTHYLSEVLVGGRADYVATTKTSAFSSEIQISVVAECSFKSVAGMDVSAKYKELIQKFQENSSTSLYAIGGTTISSITDKDTYNAWLSSIDTRPVFCGFTYESLQPIWELAESPQRQEILQKATKTFIPPEIKRNAIVDVDIIVSDNYGVNPPYSYTKIDYDLNHNAKGKFIFLCYNQQKISVAGSPADPKPITALYVASGDDDHPYVPPGYTRISSDLNEGAGGKFIYLCYTKDPAAIPSDEDGLPIRGIRVIGNENIDNVVTPYGFTKIDKDLNEGAGGDFIFVRFSPHLD

SEQ ID NO: 39 - DNA, 1353 bp, Lycopodium nummulariifolium
atggcccgtatcgagccattacctggatcggatgcaatcggacacagttatgatgtattcggattttacgccaaccccaagagcgttaatacacagctcttcgactttgcccctcagcaagaaattattttagaggaccacaaatggctcctctccactgatattgaatatattgctgtccgagaaaccgaaataaaaaccgtctctcttcgtacaaaagatgcatactccacggagctggctgcaagcgtaaaagtgtccggcagctatggcagcttctcggcttcggtagagtctgatttctcccaaagcatcagcgatgagacggattccacttacacttctgttcgtacaaatgtgaacaagtggaagctcagtctgaagccaactgtggaagaactgcgttccatgttgacaccttctttcaaggaagctttggcgagtatggactcggaggagctgtttacgacgtacgggacacattatctgagtggggtgttggtgggaggtcgcgcagattatgtcgccaccaccaaaaccagtgcattcagctctgatattcaaatcagcgtagttgcggagtgttcattcaagtccgtggctggcatggacgtatcagccaagtacaaggagcttatccagaaattccaagagaacagctccactagtctgtacgccatcggtgggaccacaatctccagcatcacagacaaagacacttacaatgcatggctcagttcgattgatatacgtcccgtcttctgtggattcacttacgaaagtcttcagcccatttgggaactcgctgaatcccctcagcgccaggagatcctgcaaaaggctacgaagacctttattccgcccgaaatcaaacgaaatgcaatcgtcgacgtagatattatcgtgtccgacaactatggggtgaatcctccctacggctatacgaagatcgattatgatctgaaccgcaatgccaagggcaaatttatctttttgtgctacaatcaacagaagatatcagtagcaggatcccctgcggatccgaagcccatcactgctttgtacgtggcttctggcgatgacgatcatccatacgttcctccaggttacaccaggatcagcagcgatctgaacgagggtgcggggggcaaatttatctatctatgctacacaaaagatccggctgcaatacccagcgacgaggatggactgcccatacgtggcatccgagttattggtaacgaaaatatcgagaatgtggttacaccttacggattcacaacgattgataaagatctgaacgagggtgcagggggagactttatctacgttcgtttctcacctcatttagac

SEQ ID NO: 40 - protein, 451 aa, Lycopodium nummulariifolium
MARIEPLPGSDAIGHSYDVFGFYANPKSVNTQLFDFAPQQEIILEDHKWLLSTDIEYIAVRETEIKTVSLRTKDAYSTELAASVKVSGSYGSFSASVESDFSQSISDETDSTYTSVRTNVNKWKLSLKPTVEELRSMLTPSFKEALASMDSEELFTTYGTHYLSGVLVGGRADYVATTKTSAFSSDIQISVVAECSFKSVAGMDVSAKYKELIQKFQENSSTSLYAIGGTTISSITDKDTYNAWLSSIDIRPVFCGFTYESLQPIWELAESPQRQEILQKATKTFIPPEIKRNAIVDVDIIVSDNYGVNPPYGYTKIDYDLNRNAKGKFIFLCYNQQKISVAGSPADPKPITALYVASGDDDHPYVPPGYTRISSDLNEGAGGKFIYLCYTKDPAAIPSDEDGLPIRGIRVIGNENIENVVTPYGFTTIDKDLNEGAGGDFIYVRFSPHLD

SEQ ID NO: 41 - DNA, 1353 bp, Lycopodium nummulariifolium
atggcccgtatcgagccattacctggatcggatgcaatcggacacagttatgatgtgttcggattttatgccaatccaaagagcgtgaagaaagagctcttcgactttgccctccagaaagaaatcactttagagggccacacttggctcctttccactgatattgaatatattgcagttcgagatacggaaataaaaaccgtctctcttcgcacaaaagatgcatactcaagcgagctggctgcaagcgtaaaactgtccggcagctatggcggattctcagcgtcggtagaatctgacttctcccaaagcatcatcgatgagacggattccacttacacttcagttcgtacaaatgtgaacaagtggaagctcagtctgaagcacactgtggaagagctacgctccaagttgaagcctgcgttgaaggaggcgttggcgaatatgaaagaagtggagctgttgagtacgtacgggacacattatatgggcgaggtgttggtgggaggtcgtgcagattatttggccaccaccaaaaccagtgcattcagctcggacactaaaatcagcacagtagcggagagttctttcaagtccgtagctggcatgaaagtatccgcggagcaaaagcagcttatcgaaaaattccaagaaaacagctccaccagtctgtacgccatcggtgggagcgcactctccagcatcacagacacggccacttacaacgcatggctcagttcgattgatacacgtcccgtcttctgtggattcactcgcgacagtcttaggcccatctgggagctcgctgaatcccctcagcgccaggagatcctccaaaaggctacgaaggcctttatttcgcccgaaatcaaacgaaatgcaatcgtcgacgtagatattatcgtgtccgacaactatggggtgaatcctccctacggctatacgaagatcgattatgatctgaaccgcaatgccaagggcaaatttatctttttgtgctacaatcaacagaagatatcagtagcaggatcccctgcggatccgaagcccatcactgccttgtacgtggcttctggcgatgacaataatccatacattcctccaggttataccaggatcaacagcgatctgaacgagggtgcggggggcaaatttatttatctatgctacacaaaagatccggctgcaatacccagcgacgaggatggactgcccatacgtggcatccgcgttattggtaacgaaaatggcgagaatgtggttacaccttacggattcacgaagattgataaagatctgaacgagggtgcagggggagattatatcttcgttcgtttctcacctcatttagac

SEQ ID NO: 42 - protein, 451 aa, Lycopodium nummulariifolium
MARIEPLPGSDAIGHSYDVFGFYANPKSVKKELFDFALQKEITLEGHTWLLSTDIEYIAVRDTEIKTVSLRTKDAYSSELAASVKLSGSYGGFSASVESDFSQSIIDETDSTYTSVRTNVNKWKLSLKHTVEELRSKLKPALKEALANMKEVELLSTYGTHYMGEVLVGGRADYLATTKTSAFSSDTKISTVAESSFKSVAGMKVSAEQKQLIEKFQENSSTSLYAIGGSALSSITDTATYNAWLSSIDTRPVFCGFTRDSLRPIWELAESPQRQEILQKATKAFISPEIKRNAIVDVDIIVSDNYGVNPPYGYTKIDYDLNRNAKGKFIFLCYNQQKISVAGSPADPKPITALYVASGDDNNPYIPPGYTRINSDLNEGAGGKFIYLCYTKDPAAIPSDEDGLPIRGIRVIGNENGENVVTPYGFTKIDKDLNEGAGGDYIFVRFSPHLD

SEQ ID NO: 43 - DNA, 1353 bp, Lycopodium nummulariifolium
atggcccgtatcgagccattacctggatcggatgcaatcggacacagttatgatgtattcggattttacgccaaccccaggagcgttaatacacagctcttcgactttgcccctcagcaagaaattattttagaggaccacaaatggctcctctccactgatattgaatatattgctgttcgagatacggaaataaaaaccgtctctcttcgtacaaaagatgcatactccacggagctggctgcgagcgtaaaagtgtccggcagctatggcagcttctcggcttcggtagagtctgatttttcccaaagcatcagcgatgagacggattccacttacacttctattcgtacaaatgtgaacaagtggaagctcagtctgaagccaactgtggaagaactgcgttccatgttgacaccttcgttcaagcaagctttggcgagtatgaactcggaggagctgtttacgacgtacgggacacattatctgagtgaggttttggtgggtggtcgcgcagattatgtcgccaccaccaaaaccagtgcattcagctctgatattcaaatcagcgtaggtgcggagtgttcattcaagtccgtggctggcatggacgtatcagccaagtacaaggagcttatccagaaattccaagagaacagctccactagtctgtacgccatcggtgggaccacaatctccagcatcacagacaaagacacttacaatgcatggctcagttcgattgatacacgtcccgtcttctgtggattcacttacgaaagtcttcagcccatttgggaactcgctgaatcccctcagcgccaggagatcctccaaaaggctacgaagacctttatttcgcccgaaatcaaacgaaatgcaatcgtcgacgtagatattatcgtgtccgacaactatggggtgaatcctccctacggctatacgaagatcgattatgatctgaaccgcaatgccaagggcaaatttatctttttgtgctacaatcaacagaagatatcagtagcaggatcccctgcggatccgaagcccatcactgccttgtacgtggcttctggcgatgacgatcatccatacgttcctccaggctataccaggatcagcagcgatctgaacgagggtgcggggggcaaatttatctatctatgctacacaaaagatccggctgcaatacccagcgacgaggatggactgcccatacgtggcatccgcgttattggtaacgaaaatatcgacaatgtggttacaccttacggattcacgaagattgataaagatctgaacgagggtgcagggggagactttatcttcgttcgtttctcacctcatttagac

SEQ ID NO: 44 - protein, 451 aa, Lycopodium nummulariifolium
MARIEPLPGSDAIGHSYDVFGFYANPRSVNTQLFDFAPQQEIILEDHKWLLSTDIEYIAVRDTEIKTVSLRTKDAYSTELAASVKVSGSYGSFSASVESDFSQSISDETDSTYTSIRTNVNKWKLSLKPTVEELRSMLTPSFKQALASMNSEELFTTYGTHYLSEVLVGGRADYVATTKTSAFSSDIQISVGAECSFKSVAGMDVSAKYKELIQKFQENSSTSLYAIGGTTISSITDKDTYNAWLSSIDTRPVFCGFTYESLQPIWELAESPQRQEILQKATKTFISPEIKRNAIVDVDIIVSDNYGVNPPYGYTKIDYDLNRNAKGKFIFLCYNQQKISVAGSPADPKPITALYVASGDDDHPYVPPGYTRISSDLNEGAGGKFIYLCYTKDPAAIPSDEDGLPIRGIRVIGNENIDNVVTPYGFTKIDKDLNEGAGGDFIFVRFSPHLD

SEQ ID NO: 45 - DNA, 1353 bp, Lycopodium nummulariifolium
atggcccgtatcgagccattacctggatcggatgcaatcggacacagttatgatgtattcggattttacgccaaccccaagagcgttaatacacagctcttcgactttgcccctcagcaagaaattattttagaggaccacaaatggctcctctccactgatattgaatatattgctgttcgagatacggaaataaaaaccgtctctcttcgtacaaaagatgcatactccacggagctggctgcaagcgtaaaagtgtccggcagctatggcagcttctcggcttcggtagagtctgatttctcccaaagcatcagcgatgagacggattccacttatacttctgttcgtacaaatgtgaacaagtggaagctcagtctgaagccaactgtggaagaactgcgttccatgttgacaccttcgttcaaggaagctttggcgagtatggacttggaggagctgtttacgacgtacgggacacattatctgagtgaggtgttggtgggaggtcgcgcagattatgtcgccaccaccaaaaccagtgcattcagctctgagattcaaatcagcgtagttgcggagtgttcattcaagtccgtggctggcatggacgtatcagccaagtacaaggagcttatccagaaattccaagagaacagctccactagtctgtacgccatcggtgggaccacaatctccagcatcacagacaaagacacttacaatgcatggctcagttcgattgatacacgtcccgtcttctgtggattcacttacgaaagtcttcagcccatttgggaactcgctgaatcccctcagcgccaggagatcctgcaaaaggctacgaagacctttatttcgcccgaaatcaaacgcaatgcaatcgtcgacgtagatattatcgtgtccgacaactatggggtgaatcctccctacggctatacgaagatcgattatgatctgaaccgcaatgccaagggcaaatttatctttttgtgctacaatcaacagaagatatcagtagcaggatcccctgcggatccgaagcccatcactgctttgtacgtggcttctggcgatgacgatcatccatacgttcctccaggctataccaggatcagcagcgatctgaacgagggtgcggggggcaaatttatctatctatgctacacaaaagatccggctgcaatacccagcgacgaggatggactgcccatacgtggcatccgcgttattggtaacgaaaatggcgagaatgtggttacaccttacggattcacgaagattgataaagatctgaacgagggtgcagggggagattatatcttcgttcgtttctcacctcatttagac

SEQ ID NO: 46 - protein, 451 aa, Lycopodium nummulariifolium
MARIEPLPGSDAIGHSYDVFGFYANPKSVNTQLFDFAPQQEIILEDHKWLLSTDIEYIAVRDTEIKTVSLRTKDAYSTELAASVKVSGSYGSFSASVESDFSQSISDETDSTYTSVRTNVNKWKLSLKPTVEELRSMLTPSFKEALASMDLEELFTTYGTHYLSEVLVGGRADYVATTKTSAFSSEIQISVVAECSFKSVAGMDVSAKYKELIQKFQENSSTSLYAIGGTTISSITDKDTYNAWLSSIDTRPVFCGFTYESLQPIWELAESPQRQEILQKATKTFISPEIKRNAIVDVDIIVSDNYGVNPPYGYTKIDYDLNRNAKGKFIFLCYNQQKISVAGSPADPKPITALYVASGDDDHPYVPPGYTRISSDLNEGAGGKFIYLCYTKDPAAIPSDEDGLPIRGIRVIGNENGENVVTPYGFTKIDKDLNEGAGGDYIFVRFSPHLD

SEQ ID NO: 47 - DNA, 1353 bp, Lycopodium nummulariifolium
atggcccgtatcgagccattacctggatcggatgcaatcggacacagttatgatgtattcggattttacgccaaccccaagagcgttaatacacagctcttcgactttgcccctcagcaagaaattattttagaggaccacaaatggctcctctccactgatattgaatatattgctgtccgagaaaccgaaataaaaaccgtctctcttcgtacaaaagatgcatactccacggagctggctgcaagcgtaaaagtgtccggcagctatggcagcttctcggcttcggtagagtctgatttctcccaaagcatcagcgatgagacggattccacttatacttctgttcgtacaaatgtgaacaagtggaagctcagtctgaagccaactgtggaagaactgcgttccatgttgacaccttcgttcaaggaagctttggcgagtatggactcggatgagctgtttacgacgtacgggacacattatctgagtgaggtgttggtgggaggtcgcgcagattatgtcgccaccaccaaaaccagtgcattcagctctgatattcaaatcagcgtagttgcggagtgttcattcaagtccgtggctggcatggacgtatcagccaagtacaaggagcttatccagaaattccaagagaacagctctactagtctgtacgccatcggtgggaccacaatctccagcatcacagacaaagacacttacaatgcatggctcagttcgattgatacacgtcccgtcttctgtggattcacttacgaaagtcttcagcccatttgggaactcgctgaatcccctcaacgccaggagatcctgcaaaaggctacgaagacctttatttcgcccgaaatcaaacgaaatgcaatcgtcgacgtagatattatcgtgtccgacaactatggggtgaatcctccctacggctatacgaagatcgattatgatctgaaccgcaatgccaagggcaaatttatctttttgtgctacaatcaacagaagatatcagtagcaggatcccctgcggatccgaagcccatcactgttttgtacgtggcttctggcgatgacgatcatccatacgttcctccaggttacaccaggatcagcagcgatctgaacgagggtgcgggggggaaatttatctatctatgctacacaaaagatccggctgcaatacccatcgacgaggatggactgcccatacgtggcatccgcgttattggtaacgaaaatatcgagaatgtggttacaccttacggattcacaacgattgataaagatctgaacgagggtgcagggggagactttatcttcgttcgtttctcacctcatttagac

SEQ ID NO: 48 - protein, 451 aa, Lycopodium nummulariifolium
MARIEPLPGSDAIGHSYDVFGFYANPKSVNTQLFDFAPQQEIILEDHKWLLSTDIEYIAVRETEIKTVSLRTKDAYSTELAASVKVSGSYGSFSASVESDFSQSISDETDSTYTSVRTNVNKWKLSLKPTVEELRSMLTPSFKEALASMDSDELFTTYGTHYLSEVLVGGRADYVATTKTSAFSSDIQISVVAECSFKSVAGMDVSAKYKELIQKFQENSSTSLYAIGGTTISSITDKDTYNAWLSSIDTRPVFCGFTYESLQPIWELAESPQRQEILQKATKTFISPEIKRNAIVDVDIIVSDNYGVNPPYGYTKIDYDLNRNAKGKFIFLCYNQQKISVAGSPADPKPITVLYVASGDDDHPYVPPGYTRISSDLNEGAGGKFIYLCYTKDPAAIPIDEDGLPIRGIRVIGNENIENVVTPYGFTTIDKDLNEGAGGDFIFVRFSPHLD

SEQ ID NO: 49 - DNA, 1353 bp, Lycopodium nummulariifolium
atggcccgtatcgagccattacctggatcggatgcaatcggacacagttatgatgtattcggattttacgccaaccccaagagcgttaatacacagctcttcgactttgcccctcagcaagaaattattttagaggaccacaaatggctcctctccactgatattgaatatattgctgtccgagaaaccgaaataaaaaccgtctctcttcgtacaaaagatgcatactccacggagctggctgcaagcgtaaaagtgtccggcagctatggcagcttctcggcttcggtagagtctgatttctcccaaagcatcagcgatgagacggattccacttatacttctgttcgtacaaatgtgaacaagtggaagctcagtctgaagccaactgtggaagaactgcgttccatgttgacaccttcgttcaaggaagctttggcgagtatggacttggaggagctgtttacgacgtacgggacacattatctgagtgaggtgttggtgggaggtcgcgcagattatgtcgccaccaccaaaaccagtgcattcagctctgagattcaaatcagcgtagttgcggagtgttcattcaagtccgtggctggcatggacgtatcagccaagtacaaggagcttatccagaaattccaagagaacagctccactagtctgtacgccatcggtgggaccacaatctccagcatcacagacaaagacacttacaatgcatggctcagttcgattgatacacgtcccgtcttctgtggattcacttacgaaagtcttcagcccatttgggaactcgctgaatcccctcagcgccaggagatcctgcaaaaggctacgaagacctttattccgcccgaaatcaaacgaaatgcaatcgtcgacgtagatattatcgtgtccgacaactatggggtgaatcctccctacagctatacgaagatcgattatgatctgaaccacaatgccaagggcaaatttatctttttgtgctacaatcaacagaagatatcagtagcaggatcccctgcggatccgaagcccatcactgccttgtacgtggcttctggcgatgacgatcatccatacgttcctccaggctataccaggatcagcagcgatctgaacgagggtgcggggggcaaatttatctatctatgctacacaaaagatccggctgcaatacccagcgacgaggatagactgcccatacgtggcatccgcgttattggtaacgaaaatatcgacaatgtggttacaccttacggattcacgaagattgataaagatctgaacgagggtgcagggggagactttatctacgttcgtttctcacctcatttagac

SEQ ID NO: 50 - protein, 451 aa, Lycopodium nummulariifolium
MARIEPLPGSDAIGHSYDVFGFYANPKSVNTQLFDFAPQQEIILEDHKWLLSTDIEYIAVRETEIKTVSLRTKDAYSTELAASVKVSGSYGSFSASVESDFSQSISDETDSTYTSVRTNVNKWKLSLKPTVEELRSMLTPSFKEALASMDLEELFTTYGTHYLSEVLVGGRADYVATTKTSAFSSEIQISVVAECSFKSVAGMDVSAKYKELIQKFQENSSTSLYAIGGTTISSITDKDTYNAWLSSIDTRPVFCGFTYESLQPIWELAESPQRQEILQKATKTFIPPEIKRNAIVDVDIIVSDNYGVNPPYSYTKIDYDLNHNAKGKFIFLCYNQQKISVAGSPADPKPITALYVASGDDDHPYVPPGYTRISSDLNEGAGGKFIYLCYTKDPAAIPSDEDRLPIRGIRVIGNENIDNVVTPYGFTKIDKDLNEGAGGDFIYVRFSPHLD

SEQ ID NO: 51 - DNA, 1353 bp, Lycopodium nummulariifolium
atggcccgtatcgagccattacctggatcggatgcaatcggacacagttatgatgtattcggattttacgccaaccccaagagcgttaatacacagctcttcgactttgcccctcagcaagaaattattttagaggaccacaaatggctcctctccactgatattgaatatattgctgttcgagatacggaaataaaaaccgtctctcttcgtacaaaagatgcatactccacggagctggctgcgagcgtaaaagtgtccggcagctatggcagcttctcggcttcggtagagtctgatttttcccaaagcatcagcgatgagacggattccacttacacttctattcgtacaaatgtgaacaagtggaagctcagtctgaagccaactgtggaagaactgcgttccatgttgacaccttcgttcaaggaagctttggcgagtatggactcggaggagctgtttacgacgtacgggacacattatctgagtgaggtgttggtgggaggtcgcgcagattatgtcgccaccaccaaaaccagtgcattcagctctgatattcaaatcagcgtagttgcggagtgttcattcaagtccgtggctggcatggacgtatcagccaagtacaaggagcttatccagaaattccaagagaacagctccactagtctgtacgccatcggtgggaccacaatctccagcatcacagacaaagacacttacaatgcatggctcagttcgattgatacacgtcccgtcttctgtggattcacttacgaaagtcttcagcccatttgggaactcgctgaatcccctcagcgccaggagatcctgcaaaaggctacgaagacctttattccgcccgaaatcaaacgaaatgcaatcgtcgacgtagatattatcgtgtccgacaactatggggtgaatcctccctacggctatacgaagatcgattatgatctgaaccgcaatgccaagggcaaatttatctttttgtgctacaatcaacagaagatatcagtagcaggatcccctgcggatccgaagcccatcactgctttgtacgtggcttctggcgatgacgatcatccatacgttcctccaggttacaccaggatcagcagcgatctgaacgagggtgcggggggcaaatttatctatctatgctacacaaaagatccggctgcaatacccagcgacgaggatggactgcccatacgtggcatctgcgttattggtaacgaaaatatcgagaatgtggttacaccttacggattcacgaagattgataaagatctgaacgagggtgcagggggagactttatcttcgttcgtttctcacctcatttagac

SEQ ID NO: 52 - protein, 451 aa, Lycopodium nummulariifolium
MARIEPLPGSDAIGHSYDVFGFYANPKSVNTQLFDFAPQQEIILEDHKWLLSTDIEYIAVRDTEIKTVSLRTKDAYSTELAASVKVSGSYGSFSASVESDFSQSISDETDSTYTSIRTNVNKWKLSLKPTVEELRSMLTPSFKEALASMDSEELFTTYGTHYLSEVLVGGRADYVATTKTSAFSSDIQISVVAECSFKSVAGMDVSAKYKELIQKFQENSSTSLYAIGGTTISSITDKDTYNAWLSSIDTRPVFCGFTYESLQPIWELAESPQRQEILQKATKTFIPPEIKRNAIVDVDIIVSDNYGVNPPYGYTKIDYDLNRNAKGKFIFLCYNQQKISVAGSPADPKPITALYVASGDDDHPYVPPGYTRISSDLNEGAGGKFIYLCYTKDPAAIPSDEDGLPIRGICVIGNENIENVVTPYGFTKIDKDLNEGAGGDFIFVRFSPHLD

SEQ ID NO: 53 - DNA, 1353 bp, Lycopodium nummulariifolium
atggcccgtatcgagccattacctggatcggatgcaatcggacacagttatgatgtattcggattttacgccaaccccaagagcgttaatacacagctcttcgactttgcccctcagcaagaaattattttagaggaccacaaatggctcctctccactgatattgaatatattgctgtccgagaaaccgaaataaaaaccgtctctcttcgtacaaaagatgcatactccacggagctggctgcaagcgtaaaagtgtccggcagctatggcagcttctcggcttcggtagagtctgatttctcccaaagcatcagcgatgagacggattccacttacacttctgttcgtacaaatgtgaacaagtggaagctcagtctgaagccaactgtggaagaactgcgttccatgttgacaccttctttcaaggaagctttggcgagtatggactcggaggagctgtttacgacgtacgggacacattatctgagtgaggtgttggtgggaggtcgcgcagattatgtcgccaccaccaaaaccagtgcattcagctctgagattcaaatcagcgtagttgcggagtgttcattcaagtccgtggctggcatggacgtatcagccaagtacaaggagcttatccagaaattccaagagaacagctccactagtctgtacgccatcggtgggaccacaatctccagcatcacagacaaagacacttacaatgcatggctcagttcgattgatacacgtcccgtcttctgtggattcacttacgaaagtcttcagcccatttgggaactcgctgaatcccctcagcgccaggagatcctgcaaaaggctacgaagacctttattccgcccgaaatcaaacgaaatgcaatcgtcgacgtagatattatcgtgtccgacaactatggggtgaatcctccctacagctatacgaagatcgattatgatctgaaccgcaatgccaagggcaaatatatctttttgtgctacaatcaacagaagatatcagtagcaggatcccctgcggatccgaagcccatcactgccttgtacgtggcttctggcgatgacaataatccatacattcctccaggttataccaggatcaacagcgatctgaacgagggtgcggggggcaaatttatttatctatgctacacaaaagatccggctgcaatacccagcgacgaggatggactgcccatacgtggcatccgcgttattggtaacgaaaatggcgagaatgtggttacaccttacggattcacgaagattgataaagatctgaacgagggtgcagggggagattatatcttcgttcgtttctcacctcatttagac

SEQ ID NO: 54 - protein, 451 aa, Lycopodium nummulariifolium
MARIEPLPGSDAIGHSYDVFGFYANPKSVNTQLFDFAPQQEIILEDHKWLLSTDIEYIAVRETEIKTVSLRTKDAYSTELAASVKVSGSYGSFSASVESDFSQSISDETDSTYTSVRTNVNKWKLSLKPTVEELRSMLTPSFKEALASMDSEELFTTYGTHYLSEVLVGGRADYVATTKTSAFSSEIQISVVAECSFKSVAGMDVSAKYKELIQKFQENSSTSLYAIGGTTISSITDKDTYNAWLSSIDTRPVFCGFTYESLQPIWELAESPQRQEILQKATKTFIPPEIKRNAIVDVDIIVSDNYGVNPPYSYTKIDYDLNRNAKGKYIFLCYNQQKISVAGSPADPKPITALYVASGDDNNPYIPPGYTRINSDLNEGAGGKFIYLCYTKDPAAIPSDEDGLPIRGIRVIGNENGENVVTPYGFTKIDKDLNEGAGGDYIFVRFSPHLD

SEQ ID NO: 55 - DNA, 1434 bp, Ophioglossum pendulum
atggaacccaacaaaggtggtgctccagccatgaaaaatgtagccaaaccttccacaaagagactcataccgtcatccattgctgcatcatcgcaaacatctgcaaatgcattaaccgagccattgcctggctctgatgccatcggccagagctacgatgcattcgggttcttcgccaatcccagaagcatcatgaaggagttgttcgagttcagtcctcaagaggagatagtcgtggaaggaaatacctggcttctctcttcggacttcgtttacaccgcaattagagacactgagacctccacggtctcacgtcgcaccaaggacgactactccaaggaattggctgtgaaggtgaagctgtctggaagctatggctatttttctgcctccgttgagtctgatttctctcagagcatttccgatgcgacggacaccacatacacttcagttcgcacccacgtcaacaagtggaggctgagcctgaaggacgatgttggggcccttcgctcgaagctgctgcctggcgtcaagcaggcgctggctaccatggatgctacgcagctctttgacacgttcgggactcactatgtgagcgaggtgcttgtgggtgggcgtgcagactacgttgccaccaccaagaccagcgcgttcagctcatccaccagcatcagcgtagcggcagaagcatcattccagtccatcgcgggtggggaggtgtctccggagtccaaggtgcttgcggagatgctgagagagaacagcagcacacgcctgtacgctcttggcgggagtgccctccccaacatcacagatccagccacgtacaacgcctggctggagtccattgacaccatccctgtcttctgcggattcactcaaaacagcctcaagtccatctcggagcttgctgactccgctcaacgccgggacgctctggccaaagcctcccaaagctatatcccatcatacgtgactcgtcctgcagtggttggcttggaggtcataatatcggacagcaactcggagagccctccctatggctacaccagaatagactacgacctcaaccgcaacgcaggaggcaaatacgtgttcctctgctacaagcagaagaacatttcagtgggaggggatgccgatgccatcaccgacgtccttgtcgtctacggaaatgaccgaaatccatctgtgccgtctggctacaccaagatcgacaaggacctcaactccggggcaggcggtaagtatatctacttctgctactccaaggacaagcggaagcaagaggagggactgcccattcgtgggcttcgtgttgttgggcctcacccaacctcagtggcaccttacggattctctaagatcgacatagatctgaatatgggtgcaggaggagattttatatacctttgcaaatcacgccatttggag

SEQ ID NO: 56 - protein, 478 aa, Ophioglossum pendulum
MEPNKGGAPAMKNVAKPSTKRLIPSSIAASSQTSANALTEPLPGSDAIGQSYDAFGFFANPRSIMKELFEFSPQEEIVVEGNTWLLSSDFVYTAIRDTETSTVSRRTKDDYSKELAVKVKLSGSYGYFSASVESDFSQSISDATDTTYTSVRTHVNKWRLSLKDDVGALRSKLLPGVKQALATMDATQLFDTFGTHYVSEVLVGGRADYVATTKTSAFSSSTSISVAAEASFQSIAGGEVSPESKVLAEMLRENSSTRLYALGGSALPNITDPATYNAWLESIDTIPVFCGFTQNSLKSISELADSAQRRDALAKASQSYIPSYVTRPAVVGLEVIISDSNSESPPYGYTRIDYDLNRNAGGKYVFLCYKQKNISVGGDADAITDVLVVYGNDRNPSVPSGYTKIDKDLNSGAGGKYIYFCYSKDKRKQEEGLPIRGLRVVGPHPTSVAPYGFSKIDIDLNMGAGGDFIYLCKSRHLE

SEQ ID NO: 57 - DNA, 1434 bp, Platycerium bifurcatum
atggaacccaacaaaggtggtgctccagccatgaaaaatgtagccaaaccttccacaaagagactcataccgtcatccattgctgcatcatcgcaaacatctgcaaatgcattaaccgagccattgcctggctctgatgccatcggccagagctacgatgcattcgggttcttcgccaatcccagaagcatcatgaaggagttgttcgagttcagtcctcaagaggagatagtcgtggaaggaaatacctggcttctctcttcggacttcgtttacaccgcaattagagacactgagacctccacggtctcacgtcgcaccaaggacgactactccaaggaattggctgtgaaggtgaagctgtctggaagctatggctatttttctgcctccgttgagtctgatttctctcagagcatttccgatgcgacggacaccacatacacttcagttcgcacccacgtcaacaagtggaggctgagcctgaaggacgatgttggggcccttcgctcgaagctgctgcctggcgtcaagcaggcgctggctaccatggatgctacgcagctctttgacacgttcgggactcactatgtgagcgaggtgcttgtgggtgggcgtgcagactacgttgccaccaccaagaccagcgcgttcagctcatccaccagcatcagcgtagcggcagaagcatcattccagtccatcgcgggtggggaggtgtctccggagtccaaggtgcttgcggagatgctgagagagaacagcagcacacgcctgtacgctcttggcgggagtgccctccccaacatcacagatccagccacgtacaacgcctggctggagtccattgacaccatccctgtcttctgcggattcactcaaaacagcctcaagcccatctcggagcttgctgactccgctcaacgccgggacgctctggccaaagcctcccaaagctatatcccatcatacgtgactcgtcctgcagtggttggcttggaggtcataatatcggacagcaactcggagagccctccctatggctacaccagaatagactacgacctcaaccgcaacgcaggaggcaaatacgtgttcctctgctacaagcagaagaacatttcagtgggaggggatgccgatgccatcaccgacgtccttgtcgtctacggaaatgaccgaaatccatctgtgccgtctggctacaccaagatcgacaaggacctcaactccggggcaggcggtaagtatatctacttctgctactccaaggacaagcggaagcaagaggagggactgcccattcgtgggcttcgtgttgttgggcctcacccaacctcagtggcaccttacggattctctaagatcgacatagatctgaatatgggtgcaggaggagattttatatacctttgcaaatcacgccatttggag

SEQ ID NO: 58 - protein, 478 aa, Platycerium bifurcatum
MEPNKGGAPAMKNVAKPSTKRLIPSSIAASSQTSANALTEPLPGSDAIGQSYDAFGFFANPRSIMKELFEFSPQEEIVVEGNTWLLSSDFVYTAIRDTETSTVSRRTKDDYSKELAVKVKLSGSYGYFSASVESDFSQSISDATDTTYTSVRTHVNKWRLSLKDDVGALRSKLLPGVKQALATMDATQLFDTFGTHYVSEVLVGGRADYVATTKTSAFSSSTSISVAAEASFQSIAGGEVSPESKVLAEMLRENSSTRLYALGGSALPNITDPATYNAWLESIDTIPVFCGFTQNSLKPISELADSAQRRDALAKASQSYIPSYVTRPAVVGLEVIISDSNSESPPYGYTRIDYDLNRNAGGKYVFLCYKQKNISVGGDADAITDVLVVYGNDRNPSVPSGYTKIDKDLNSGAGGKYIYFCYSKDKRKQEEGLPIRGLRVVGPHPTSVAPYGFSKIDIDLNMGAGGDFIYLCKSRHLE

SEQ ID NO: 59 - DNA, 1410 bp, Ophioglossum pendulum
  misc_feature (924)..(924): n is a, c, g, or t
atgctcccggccgccatggcggccgcgggaattcgatttgaattaggcatgcgaggatccgaacccaacaaaggtggtgctccagccatgaaaaatgtagccaaaccttccacaaagagactcataccgtcatccattgctgcatcatcgcaaacatctgcaaatgcattaaccgagccattgcctggctctgatgccatcggccagagctacgatgcattcgggttcttcgccaatcccagaagcatcatgaaggagttgttcgagttcagtcctcaagaggagatagtcgtggaaggaaatacctggcttctctcttcggaattcgtttacaccgcaattagagacactgagacctccacggtctcacgtcgcaccaaggacgactactccaaggaattggctgtgaaggtgaagctgtctggaagctatggctatttttctgcctccgttgagtctgatttctctcagagcatttccgatgtgacggacaccacatacacttcagttcgcacccacgtcaacaagtggaggctgagcctgaaggacgatgttggggcccttcgctcgaagctgctgcctggcgtcaagcaggcgctggctaccatggatgctacgcagctctttgacacgttcgggactcactatgtgagcgaggtgcttgtgggtgggcgtgcagactacgttgccaccaccaagaccagcgcgttcagctcatccaccagcatcagcgtagcggcagaagcatcattccagtccatcgcgggtggggaggtgtctccggagtccaaggtgcttgcggagacgctgagagagaacagcagcacacgcctgtacgctcttggcgggagtgccctccccaacatcacagatccagccacgtacaacgcctggctggagtccattgacaccatccctgtcttntgcggattcactcaaaacagcctcaagcccatctcggagcttgctgactccgctcaacgccgggacgctctggccaaagcctcccaaagctatatcccatcatacgtgactcgtcctgcagtggttggcttggaggtcataatatcggacagcaactcggagagccctccctatggctacaccagaatagactacgacctcaaccgcaacgcaggaggcaaatacgtgttcctctgctacaagcagaagaacatttcagtgggaggggatgccgatgccatcaccgacgtccttgtcgtctacggaaatgaccgaaatccatctgtgccgtctggctacaccaagatcgacaaggacctcaactccggggcaggcggtaagtatatctacttctgctactccaaggacaagcggaagcaagaggagggactgcccattcgtgggcttcgtgttgttgggcctcacccaacctcagtggcaccttac

SEQ ID NO: 60 - protein, 451 aa, Ophioglossum pendulum
  misc_feature (289)..(289): Xaa can be any naturally occurring amino acid
MEPNKGGAPAMKNVAKPSTKRLIPSSIAASSQTSANALTEPLPGSDAIGQSYDAFGFFANPRSIMKELFEFSPQEEIVVEGNTWLLSSEFVYTAIRDTETSTVSRRTKDDYSKELAVKVKLSGSYGYFSASVESDFSQSISDVTDTTYTSVRTHVNKWRLSLKDDVGALRSKLLPGVKQALATMDATQLFDTFGTHYVSEVLVGGRADYVATTKTSAFSSSTSISVAAEASFQSIAGGEVSPESKVLAETLRENSSTRLYALGGSALPNITDPATYNAWLESIDTIPVXCGFTQNSLKPISELADSAQRRDALAKASQSYIPSYVTRPAVVGLEVIISDSNSESPPYGYTRIDYDLNRNAGGKYVFLCYKQKNISVGGDADAITDVLVVYGNDRNPSVPSGYTKIDKDLNSGAGGKYIYFCYSKDKRKQEEGLPIRGLRVVGPHPTSVAPY

SEQ ID NO: 61 - DNA, 1491 bp, Ophioglossum pendulum
atggtcgacctgcaggcggccgcgaattcactagtgattgaattaggcatgagaggatccgaacccaacaaaggtggtgctccagccatgaaaaatgtagccaaaccttccacaaagagactcataccgtcatccattgctgcatcatcgcaaacatctgcaaatgcattaaccgagccattgcctggctctgatgccatcggccagagctacgatgcattcgggttcttcgccaatcccagaagcatcatgaaggagttgttcgagttcagtcctcaagaggagatagtcatggaaggaaatacctggcttctctcttcggacttcgtttacaccgcaattagagacactgagacctccacggtctcacgtcgcaccaaggacgactactccaaggaattggctgtgaaggtgaagctgtctggaagctatggctatttttctgcctccgttgagtctgatttctctcagagcatttccgatgcgacggacaccacatacacttcagttcgcacccacgtcaacaagtggaggctgagcctgaaggacgatgttggggcccttcgctcgaagctgctgcctggcgtcaagcaggcgctggctaccatggatgctacgcagctctttgacacgttcgggactcactatgtgagcgaggtgcttgtgggtgggcgtgcagactacgttgccaccaccaagaccagcgcgttcagctcatccaccagcatcagcgtagcggcagaagcatcattccagtccatcgcgggtggggaggtgtctccggagtccaaggtgcttgcggagatgctgagagagaacagcagcacacgcctgtacgctcttggcgggagtgccctccccaacatcacagatccagccacgtacaacgcctggctggagtccattgacaccatccctgtcttctgcggattcactcaaaacagcctcaagcccatctcggagcttgctgactccgctcaacgccgggacgctctggccaaagcctcccaaagctatatcccatcatacgtgactcgtcctgcagtggttggcttggaggtcataatatcggacagcaactcggagagccctccctatggctacaccagaatagactacgacctcaaccgcaacgcaggaggcaaatacgtgttcctctgctacaagcagaagaacatttcagtgggaggggatgccgatgccatcaccgacgtccttgtcgtctacggaaatgaccgaaatccatctgtgccgtctggctacaccaagatcgacaaggacctcaactccggggcaggcggtaagtatatctacttctgctactccaaggacaagcggaagcaagaggagggactgcccattcgtgggcttcgtgttgttgggcctcacccaacctcagtggcaccttacggattctctaagatcgacatagatctgaatatgggtgcaggaggagattttatatacctttgcaaatcacgccatttggag

SEQ ID NO: 62 - protein, 478 aa, Ophioglossum pendulum
MEPNKGGAPAMKNVAKPSTKRLIPSSIAASSQTSANALTEPLPGSDAIGQSYDAFGFFANPRSIMKELFEFSPQEEIVMEGNTWLLSSDFVYTAIRDTETSTVSRRTKDDYSKELAVKVKLSGSYGYFSASVESDFSQSISDATDTTYTSVRTHVNKWRLSLKDDVGALRSKLLPGVKQALATMDATQLFDTFGTHYVSEVLVGGRADYVATTKTSAFSSSTSISVAAEASFQSIAGGEVSPESKVLAEMLRENSSTRLYALGGSALPNITDPATYNAWLESIDTIPVFCGFTQNSLKPISELADSAQRRDALAKASQSYIPSYVTRPAVVGLEVIISDSNSESPPYGYTRIDYDLNRNAGGKYVFLCYKQKNISVGGDADAITDVLVVYGNDRNPSVPSGYTKIDKDLNSGAGGKYIYFCYSKDKRKQEEGLPIRGLRVVGPHPTSVAPYGFSKIDIDLNMGAGGDFIYLCKSRHLE

SEQ ID NO: 63 - DNA, 1443 bp, Ophioglossum pendulum
  misc_feature (833)..(833): n is a, c, g, or t
  misc_feature (873)..(873): n is a, c, g, or t
  misc_feature (876)..(876): n is a, c, g, or t
atgcgaggatccgaacccaacaaaggtggtgctccagccatgaaaaatgtagccaaaccttccacaaagacactcataccgtcatccattgctgcatcatcgcaaacagctgcaaatgcattaaccgagccattgcctggctctgatgccatcggccagagctacaatgcattcgggttctttgccaatcccagaagcatcatgaaggagttgtttgagttcagtcctcaagaggagatagtcgtggaaggaaatacctggcttctctcttcggacttcgtttacaccgcaattagagacagtgaggccttcacgctctcacatcgcaccaaggacgactactccaaggaattggctctgaaggtgaagctgtctggaagctatggctttttttctgcctccgttgagtctgatttctctcagagcatttccgatgtgacggacaccacatacacttcagttcgcacccacgtcaacaagtggaggctgagcctgaaggacgatgttggggcccttcgctcgaagctgctgcctggcttcaagcaggcgctggctaccatggatgctacgcagctctttgacacgttcgggactcactatgtgagcgaggtgcttgtgggtgggcgtgcagactacgttgccaccaccaagaccagcgcgttcagctcgtccaccagcatcagcgtagcggcagaagcatcattcaagtccatcgcgggtggggaggtgtctccggagtccaaggagcttgcggagacgctgagagagaacagcagcacacgactgtacgctcttggcgggagtgccctcaccaacatcacagatccagccangtacaacgcctggctgcagtccattgacaccatccctgtnttntgcggattcactcaaaacagcctcaagcccatctcggagcttgctgactccgctcaacgccgggacgctctggccaaagcctcccaaagctatatcccatcatacgtgactcgtcctgcagtggttggcttggaggtcataatatcggacagcaactcagagagccctccctatggctacaccagaatagactacgacctcaaccgcaacgcaggaggcaaatacgtgttcctctgctacaagcagaagtacatttcagtgggaggggatgccgatgccatcaccgacgtccttgtcgtctacggaaatgaccgaaatccatctgtgccgtctggctacaccaagatcgacaaggacctcaactccggggcaggaggtaagtatatctacttctgctactccaaggacaagcacaagcaagaggagggactgcccattcgtgggcttcgtgttgttgggcctcacccaacctcagtggcaccttacggattctctaagatcgacatagatctgaatatgggtgcaggaggagattttatatacctttgcaaatcacgccatttggag

SEQ ID NO: 64 - protein, 478 aa, Ophioglossum pendulum
  misc_feature (275)..(275): Xaa can be any naturally occurring amino acid
  misc_feature (289)..(289): Xaa can be any naturally occurring amino acid
MEPNKGGAPAMKNVAKPSTKTLIPSSIAASSQTAANALTEPLPGSDAIGQSYNAFGFFANPRSIMKELFEFSPQEEIVVEGNTWLLSSDFVYTAIRDSEAFTLSHRTKDDYSKELALKVKLSGSYGFFSASVESDFSQSISDVTDTTYTSVRTHVNKWRLSLKDDVGALRSKLLPGFKQALATMDATQLFDTFGTHYVSEVLVGGRADYVATTKTSAFSSSTSISVAAEASFKSIAGGEVSPESKELAETLRENSSTRLYALGGSALTNITDPAXYNAWLQSIDTIPVXCGFTQNSLKPISELADSAQRRDALAKASQSYIPSYVTRPAVVGLEVIISDSNSESPPYGYTRIDYDLNRNAGGKYVFLCYKQKYISVGGDADAITDVLVVYGNDRNPSVPSGYTKIDKDLNSGAGGKYIYFCYSKDKHKQEEGLPIRGLRVVGPHPTSVAPYGFSKIDIDLNMGAGGDFIYLCKSRHLE

SEQ ID NO: 65 - DNA, 1443 bp, Ophioglossum pendulum
atgcgaggatccgaacccaacaaaggtggtgctccagccatgaaaaatgtagccaaaccttccacaaagagactcataccgtcatccattgctgcatcatcgcaaacatctgcaaatgcattaaccgagccattgcctggctctgatgccatcggccagagctacgatgcattcgggttcttcgccaatcccagaagcatcatgaaggagttgttcgagttcagtcctcaagaggagataatcgtggaaggaaatacctggcttctctcttcggacttcgtttacaccgcaattagagacactgagacctccacggtctcacgtcgcaccaaggacgactactccaaggaattggctgtgaaggtgaagctgtctggaagctatggctatttttctgcctccgttgagtctgatttctctcagagcatttccgatgcgacggacaccacatacacttcagttcgcacccacgtcaacaagtggaggctgagcctgaaggacgatgttggggcccttcgctcgaagctgctgcctggcgtcaagcaggcgctggctaccatggatgctacgcagctctttgacacgttcgggactcactgtgtgagcgaggtgcttgtgggtgggcgtgcagactacgttgccaccaccaagaccagcgcgttcagctcatccaccagcatcagcgtagcggcagaagcatcattccagtccatcgcgggtggggaggtgtctccggagtccaaggtgcttgcggagatgctgagagagaacagcagcacacgcctgtacgctcttggcgggagtgccctccccaacatcacagatccagccacgtacaacgcctggctggagtccattgacaccatccctgtcttctgcggattcactcaaaacagcctcaagcccatctcggagcttgctgactccgctcaacgccgggacgctctggccaaagcctcccaaagctatatcccatcatacgtgactcgtcctgcagtggttggcttggaggtcataatatcggacagcaactcggagagccctccctatggctacaccagaatagactacgacctcaaccgcaacgcaggaggcaaatacgtgttcctctgctacaagcagaagaacatttcagtgggaggggatgccgatgccatcaccgacgtccttgtcgtctacggaaatgaccgaaatccatctgtgccgtctggctacaccaagatcgacaaggacctcaactccggggcaggcggtaagtatatctacttctgctactccaaggacaagcggaagcaagaggagggactgcccattcgtgggcttcgtgttgttgggcctcacccaacctcagtggcaccttacggattctctaagatcgacatagatctgaatatgggtgcaggaggagattttatatacctttgcaaatcacgccatttggag

SEQ ID NO: 66 - protein, 478 aa, Ophioglossum pendulum
MEPNKGGAPAMKNVAKPSTKRLIPSSIAASSQTSANALTEPLPGSDAIGQSYDAFGFFANPRSIMKELFEFSPQEEIIVEGNTWLLSSDFVYTAIRDTETSTVSRRTKDDYSKELAVKVKLSGSYGYFSASVESDFSQSISDATDTTYTSVRTHVNKWRLSLKDDVGALRSKLLPGVKQALATMDATQLFDTFGTHCVSEVLVGGRADYVATTKTSAFSSSTSISVAAEASFQSIAGGEVSPESKVLAEMLRENSSTRLYALGGSALPNITDPATYNAWLESIDTIPVFCGFTQNSLKPISELADSAQRRDALAKASQSYIPSYVTRPAVVGLEVIISDSNSESPPYGYTRIDYDLNRNAGGKYVFLCYKQKNISVGGDADAITDVLVVYGNDRNPSVPSGYTKIDKDLNSGAGGKYIYFCYSKDKRKQEEGLPIRGLRVVGPHPTSVAPYGFSKIDIDLNMGAGGDFIYLCKSRHLE

SEQ ID NO: 67 - DNA, 1491 bp, Ophioglossum pendulum
atggtcgacctgcaggcggccgcgaattcactagtgattgaattaggcatgcgaggatccgaacccaacaaaggtggtgctccagccatgaaaaatgtagccaaaccttccacaaagagactcataccgtcatccattgctgcatcatcgcaaacatctgcaaatgcattaaccgagccattgcctggctctgatgccatcggccagagctacgatgcgttcgggttcttcgccaatcccagaagcatcatgaaggagttgtttgagttcagtcctcaagaggagatagtcgtggaaggaaatacctggcttctctcttcggacttcgtttacaccgcaattagagacagtgaggccttcacgctctcacatcgcaccaaggacgactactccaaggaattggctctgaaggtgaagctgtctggaagctatggctttttttctgcctccgttgagtctgatttctctcagagcatttccgatgtgacggacaccacatacacttcagttcgcacccacgtcaacaagtggaggctgagcctgaaggacgatgttggggcccttcgctcgaagctgctgcctggcttcaagcaggcgctggctaccatggatgctacgcagctctttgacacgttcgggactcactatgtgagcgaggtgcttgtgggtgggcgtgcagactacgttgccaccaccaagaccagcgcgttcagctcgtccaccagcatcagcgtagcggcagaagcatcattcaagtccatcgcgggtggggaggtgtctccggagtccaaggagcttgcggagacgctgagagagaacagcagcacacgactgtacgctcttggcgggagtgccctcaccaacatcacagatccagccacgtacaacgcctggctgcagtccattgacaccatccctgtcttctgcggattcactcaaaacagcctcaagcccatctcggagcttgctgactccgctcaacgccgggacgctctggccaaagcctcccaaagctatatcccatcatacgtgactcgtcctgcagtggttggcttggaggtcataatatcggacagcaactcggagagccctccctatggctacaccagaatagactacgacctcaaccgcaacgcaggaggcaaatacgtgttcctctgctacaagcagaagaacatttcagtgggaggggatgcggatgccatcaccgacgtccttgtcgtctacggaaatgaccgaaatccatctgtgccgtctggctacaccaagatcgacaaggacctcaactccggggcaggcggtaagtatatctacttctgctactccaaggacaagcggaagcaagaggagggactgcctattcgtgggcttcgtgttgttgggcctcacccaacctcagtggcaccttacggattctctaagatcgacatagatctgaatatgggtgcaggaggagattttatatacctttgcaaatcacgccatttggag

SEQ ID NO: 68 - protein, 478 aa, Ophioglossum pendulum
MEPNKGGAPAMKNVAKPSTKRLIPSSIAASSQTSANALTEPLPGSDAIGQSYDAFGFFANPRSIMKELFEFSPQEEIVVEGNTWLLSSDFVYTAIRDSEAFTLSHRTKDDYSKELALKVKLSGSYGFFSASVESDFSQSISDVTDTTYTSVRTHVNKWRLSLKDDVGALRSKLLPGFKQALATMDATQLFDTFGTHYVSEVLVGGRADYVATTKTSAFSSSTSISVAAEASFKSIAGGEVSPESKELAETLRENSSTRLYALGGSALTNITDPATYNAWLQSIDTIPVFCGFTQNSLKPISELADSAQRRDALAKASQSYIPSYVTRPAVVGLEVIISDSNSESPPYGYTRIDYDLNRNAGGKYVFLCYKQKNISVGGDADAITDVLVVYGNDRNPSVPSGYTKIDKDLNSGAGGKYIYFCYSKDKRKQEEGLPIRGLRVVGPHPTSVAPYGFSKIDIDLNMGAGGDFIYLCKSRHLE

SEQ ID NO: 69 - DNA, 1443 bp, Ophioglossum pendulum
atgcgaggatccgaacccaacaaaggtggtgctccagccatgaaaaatgtagccaaaccttccacaaagagactcataccgtcatccattgctgcatcatcgcaaacatctgcaaatgcattaaccgagccattgcctggctctgatgccatcggccagagctacgatgcattcgggttcttcgccaatcccagaagcatcatgaaggagttgttcgagttcagtcctcaaaaggagatagtcgtggaaggaaatacctggcttctctcttcggacttcgtttacaccgcaattagagacactgagacctccacggtctcacgtcgcaccaaggacgactactccaaggaattggctgtgaaggtgaagctgtctggaagctatggctatttttctgcctccgttgagtctgatttctctcagagcatttccgatgcgacggacaccacatacacttcagttcgcacccacgtcaacaagtggaggctgagcctgaaggacgatgttggggcccttcgctcgaagctgctgcctggcgtcaagcaggcgctggctaccatggatgctacgcagctctttgacacgttcgggactcactatgtgagcgaggtgcttgtgggtgggcgtgcagactacgttgccaccaccaagaccagcgcgttcagctcatccaccagcatcagcgtagcggcagaagcatcattccagtccatcgcgggtggggaggtgtctccggagtccaaggtgcttgcggagatgctgagagagaacagcagcacacgcctgtacgctcttggcgggagtgccctccccaacatcacagatccagtcacgtacaacgcctggctggagtccattgacaccatccctgtcttctgcggattcactcaaaacagcctcaagcccatctcggagcttgctgactccgctcaacgccgggacgctctggccaaagcctcccaaagctatatcccatcatacgtgactcgtcctgcagtggttggcttggaggtcataatatcggacagcaactcggagagccctccctatggctacaccagaatagactacgacctcaaccgcaacgcaggaggcaaatacgtgttcctctgctacaagcagaagaacatttcagtgggaggggatgccgatgccatcaccgacgtccttgtcgtctacggaaatgaccgaaatccatctgtgccgtctggctacaccaagatcgacaaggacctcaactccggggcaggcggtaagtatatctacttctgctactccaaggacaagcggaagcaagaggagggactgcccattcgtgggcttcgtgttgttgggcctcacccaacctcagtggcaccttacggattctctaagatcgacatagatctgaatatgggtgcaggaggagattttatatacctttgcaaatcacgccatttggag

SEQ ID NO: 70 - protein, 478 aa, Ophioglossum pendulum
MEPNKGGAPAMKNVAKPSTKRLIPSSIAASSQTSANALTEPLPGSDAIGQSYDAFGFFANPRSIMKELFEFSPQKEIVVEGNTWLLSSDFVYTAIRDTETSTVSRRTKDDYSKELAVKVKLSGSYGYFSASVESDFSQSISDATDTTYTSVRTHVNKWRLSLKDDVGALRSKLLPGVKQALATMDATQLFDTFGTHYVSEVLVGGRADYVATTKTSAFSSSTSISVAAEASFQSIAGGEVSPESKVLAEMLRENSSTRLYALGGSALPNITDPVTYNAWLESIDTIPVFCGFTQNSLKPISELADSAQRRDALAKASQSYIPSYVTRPAVVGLEVIISDSNSESPPYGYTRIDYDLNRNAGGKYVFLCYKQKNISVGGDADAITDVLVVYGNDRNPSVPSGYTKIDKDLNSGAGGKYIYFCYSKDKRKQEEGLPIRGLRVVGPHPTSVAPYGFSKIDIDLNMGAGGDFIYLCKSRHLE

SEQ ID NO: 71 - DNA, 1353 bp, Huperzia goebelii
atggcccaaatagagccattacctggatcggatgcaatcggacacagttatgatgtattcggattttacgccaaccccaagagcgttaatagacagctcttcgactttgcccctcagcaagaaattactttagaggaccacacatggctcctctccactgatattgtatatattgctgtccgggatacggatataaaaaccgtctctcttcgcacaaaagattcatactccacggagctggctgcaagcgtaaaagtgtccggcagctatggcagcttctcggcttcggtagagtctgatttctcccaaagcatcagcgatgagacggattccacttacacttcagttcgtacaaatgtgaacaagtggaagctcagtctgaagccaactgtggaagaactgcgttccatgttgacaccttcgttcaaggaagctttggcgagtatgaactcggaggagctgtttacgacgtacggaacacattatctgagtgaggtgttggtgggaggtcgcgcagattatgtcgccaccaccaaaaccagtgcattcagctctgatattcaaatcagcgtagttgcggagagttcattcaagtccgtggctggcatggacgtatcatccaagtacaaggaacttatccagatattccaagagaacagctccactagtctgtacgccattggtgggaccgcactctccagcatcacagacacggacacttacaatgcatggctcagttcgattgatacacttcccgtcttctgtggattcacttacgaaagtcttcagcccatctgggaactcgctgaatcccctcagcgccaggagatcctccagaaggctacgaagacctttattccgcccgaaatcagacgaaatgcgatcgtcgacgtagatattatcgtgtccgacaactattgggtgaatcctccctacggctatacgaagatcgattatgatctgaaccgcaatgccaagggcaaatatatctttttgtgctacaatcaacagaagatatcagtagcaggatcccctgcggatccgaagcccatcactgccttgtacgtggcttctggcgatgacgatcatccatacattcctccaggttataccaggatcaacagcgatctgaacgagggtgcggggggcaaatatatctatctatgctacacaaaagatccggctgcaatacccagcgacgaggatggactgcccatacgtggcatccgcgttattggtaacgaaaaagtcgagaatgtggttacaccttacggattcacgaagattgataaagatctgaacgagggtgcagggggagactatatcttcgtttgtttctcacgtcatttagac

SEQ ID NO: 72 - protein, 451 aa, Huperzia goebelii
MAQIEPLPGSDAIGHSYDVFGFYANPKSVNRQLFDFAPQQEITLEDHTWLLSTDIVYIAVRDTDIKTVSLRTKDSYSTELAASVKVSGSYGSFSASVESDFSQSISDETDSTYTSVRTNVNKWKLSLKPTVEELRSMLTPSFKEALASMNSEELFTTYGTHYLSEVLVGGRADYVATTKTSAFSSDIQISVVAESSFKSVAGMDVSSKYKELIQIFQENSSTSLYAIGGTALSSITDTDTYNAWLSSIDTLPVFCGFTYESLQPIWELAESPQRQEILQKATKTFIPPEIRRNAIVDVDIIVSDNYWVNPPYGYTKIDYDLNRNAKGKYIFLCYNQQKISVAGSPADPKPITALYVASGDDDHPYIPPGYTRINSDLNEGAGGKYIYLCYTKDPAAIPSDEDGLPIRGIRVIGNEKVENVVTPYGFTKIDKDLNEGAGGDYIFVCFSRHLD

SEQ ID NO: 73 - DNA, 1353 bp, Huperzia goebelii
atggcccaaatagagccattacctggatcggatgcaatcggacacagttatgatgtattcggattttacgccaaccccaagagcgttaatagacagctcttcgactttgcccctcagcaagaaattactttagaggaccacacatggctcctctccactgatattgtatatattgctgtccgggatacggatataacaaccgtctctcttcgcacaaaagattcatactccacggagctggctgcaagcgtaaaagtgtccggcagctatggcagcttctcggcttcggtagagtctgatttctcccaaagcatcagcgatgagacggattccacttacacttcagttcgtacaaatgtgaacaagtggaagctcagtctgaagccaactgtggaagaactgcgttccatgttgacaccttcgttcaaggaagctttggcgagtatgaactcggaggagctgtttacgacgtacggaacacattatctgagtgaggtgttggtgggaggtcgcgcagattatgtcgccaccaccaaaaccagtgcattcagctctgatattcaaatcagcgtagttgcggagagttcattcaagtccgtggctggcatggacgtatcatccaagtacaaggaacttatccagatattccaagagaacagctccactagtctgtacgccattggtgggaccgcactctccagcatcacagacacggacacttacaatgcatggctcagttcgattgatacacttcccgtcttctgtggattcacttacgaaagtcttcagcccatctgggaactcgctgaatcccctcagcgccaggagatcctccagaaggctacgaagacctttattccgcccgaaatcagacgaaatgcgatcgtcgacgtagatattatcgtgtccgacaactattgggtgaatcctccctacggctatacgaagatcgattatgatctgaaccgcaatgccaagggcaaatatatctttttgtgctacaatcaacagaagatatcagtagcaggatcccctgcggatccgaagcccatcactgccttgtacgtggcttctggcgatgacgatcatccatacattcctccaggttataccaggatcaacagcgatctgaacgagggtgcggggggcaaatatatctatctatgctacacaaaagatccggctgcaatacccagcgacgaggatggactgcccatacgtggcatccgcgttattggtaacgaaaaagtcgagaatgtggttacaccttacggattcacgaagattgataaagatctgaacgagggtgcagggggagactatatcttcgtttgtttctcacgtcatttagac

SEQ ID NO: 74 - protein, 451 aa, Huperzia goebelii
MAQIEPLPGSDAIGHSYDVFGFYANPKSVNRQLFDFAPQQEITLEDHTWLLSTDIVYIAVRDTDITTVSLRTKDSYSTELAASVKVSGSYGSFSASVESDFSQSISDETDSTYTSVRTNVNKWKLSLKPTVEELRSMLTPSFKEALASMNSEELFTTYGTHYLSEVLVGGRADYVATTKTSAFSSDIQISVVAESSFKSVAGMDVSSKYKELIQIFQENSSTSLYAIGGTALSSITDTDTYNAWLSSIDTLPVFCGFTYESLQPIWELAESPQRQEILQKATKTFIPPEIRRNAIVDVDIIVSDNYWVNPPYGYTKIDYDLNRNAKGKYIFLCYNQQKISVAGSPADPKPITALYVASGDDDHPYIPPGYTRINSDLNEGAGGKYIYLCYTKDPAAIPSDEDGLPIRGIRVIGNEKVENVVTPYGFTKIDKDLNEGAGGDYIFVCFSRHLD

SEQ ID NO: 75 - DNA, 1353 bp, Huperzia carinata
atggcccaaatcgagccattacctggatcggatgcaatcggacacagttatgatgtattcggattctatgccaaccccaagagcgtgaaaagagagctcttcgactttgcccctcagcaagaaattactgaagagggccacacttggctcctttccactgatattgtaaatactgctgtccgagatacggaaataaaaaccgtctctcttcgcacaaaagatgaatactccacggagctggctgcaagcgtaaaagtgtccggcagctatggcggcttctcggcttcggtagagtctgatttctcccaaagcatcagccaggagacggactccacttacacttcagttcgtacaaatgtgaccaaatggaagctcggtctcaagccaactgtcgaagaactgcgttccatgttgacgccttcgttcaaggaggcattggcgagtatggagtcggaggagctgtttacgacgtacgggacatattatctgagtgaggtgttggtgggaggtcgcgcagattacgtggccaccaccaaaaccagtgcattcagctctgatactcaaatcagcgtagttgcggagagttcattcaagtccgtggctggcatggaggtatcctcccagtacaaggagcttatcaagaaatttcaagagaacagctccactcgtctgtacgccatcggtgggaccgcactctccagcatcacagacacggccacttacaacgcatggctcagttccattgatacacgtcccgtcttctgtggattcactcgcgacagtcttaggcccatctgggagctcgctgaatcccctcagcgccgggagattctccgaaaagctacccaaacgtttatcccaccagaaatcacacgaaatgcaatcgttggcgtagatattatcatgtctgacaactattgggtgaatcctccctacggctatacgaagatcgattatgatctgaaccgcaatgccaagggcaaatatatcttcttgtgttacaaacaacagaagatatcagtagctggatccccagcggatcccaagcccatcactgccttgtacgtggcttctggcgatgatgataatccatatgttcccgcaggttacaccatgatcaacacagatctgaaccagggtgcgaagggcaagtttatctatctctgctacacaaaagatccggctgcaatacccagcgacgaggatggactgcccatacgtggcctccgcgttattggtaacccacaagtcgagaatgtggttacaccttacggattcacgaggattaataaagatctgaatgagggtgcaaagggagagtatatctacgtttgtttctcacgtcatttagac

SEQ ID NO: 76 - protein, 451 aa, Huperzia carinata
MAQIEPLPGSDAIGHSYDVFGFYANPKSVKRELFDFAPQQEITEEGHTWLLSTDIVNTAVRDTEIKTVSLRTKDEYSTELAASVKVSGSYGGFSASVESDFSQSISQETDSTYTSVRTNVTKWKLGLKPTVEELRSMLTPSFKEALASMESEELFTTYGTYYLSEVLVGGRADYVATTKTSAFSSDTQISVVAESSFKSVAGMEVSSQYKELIKKFQENSSTRLYAIGGTALSSITDTATYNAWLSSIDTRPVFCGFTRDSLRPIWELAESPQRREILRKATQTFIPPEITRNAIVGVDIIMSDNYWVNPPYGYTKIDYDLNRNAKGKYIFLCYKQQKISVAGSPADPKPITALYVASGDDDNPYVPAGYTMINTDLNQGAKGKFIYLCYTKDPAAIPSDEDGLPIRGLRVIGNPQVENVVTPYGFTRINKDLNEGAKGEYIYVCFSRHLD

SEQ ID NO: 77 - DNA, 1353 bp, Huperzia carinata
atggcccaaatcgagccattacctggatcggatgcaatcggacacagttatgatgtattcggattctatgccaaccccaagagcgtgaaaagagagctcttcgactttgcccctcagcaagaaattactgaagagggccacacttggctcctttccactgatattgtaaatactgctgtccgagatacggaaataaaaaccgtctctcttcgcacaaaagatgaatactccacggagctggctgcaagcgtaaaagtgtccggcagctatggcggcttctcggcttcggtagagtctgatttctcccaaagcatcagccaggagacggactccacttacacttcagttcgtacaaatgtgaccaaatggaagctcggtctcaagccaactgtcgaagaactgcgttccatgttgacgccttcgttcaaggaggcattggcgagtatggagtcggaggagctgtttacgacgtacgggacatattatctgagtgaggtgttggtgggaggtcgcgcagattacgtggccaccaccaaaaccagtgcattcagctctgatactcaaatcagcgtagttgcggagagttcattcaagtccgtggctggcatggaggtatcctcccagtacaatgagcttatcaagaaatttcaagagaacagctccactcgtctgtacgccatcggtgggaccgcactctccagcatcacagacacggccacttacaacgcatggctcagttcgattgatacacttcccgtcttctgtggattcactagcgcaagtcttaagcccatctgggaactcgctgaatcctctcagcgccaggagatcctgcaaaaggctgcgcagacctttatcccgctcgaaatcagacgaaatgcgatcgttgacgtagctattatcgtgtccgacaaccatctggtgaatcctccctacggctttacgaagatcgattttgatctgaaccgcggtgccaagggcaaatttatctatttgtgctacaagcaacagaagatatcagtagcaggatcccctgcggatccgaaacccatcactgccttgaacgtggtttctagcgattaccatgatccatccgctccttcaggttataccatgatcaacacagatctgaaccagggtgcgaagggcaagtttatctatctctgctacacaaaagatccggctgcaatacccagcgacgaggatggactgcccatacgtggcctccgcgttattggtaacccacaagtcgagaatgtggttacaccttacggattcacgaggatcaataaagatctgaatgagggtgcaaagggagagtttatctacgtttgtttctcacgtcatttagac

SEQ ID NO: 78 - protein, 451 aa, Huperzia carinata
MAQIEPLPGSDAIGHSYDVFGFYANPKSVKRELFDFAPQQEITEEGHTWLLSTDIVNTAVRDTEIKTVSLRTKDEYSTELAASVKVSGSYGGFSASVESDFSQSISQETDSTYTSVRTNVTKWKLGLKPTVEELRSMLTPSFKEALASMESEELFTTYGTYYLSEVLVGGRADYVATTKTSAFSSDTQISVVAESSFKSVAGMEVSSQYNELIKKFQENSSTRLYAIGGTALSSITDTATYNAWLSSIDTLPVFCGFTSASLKPIWELAESSQRQEILQKAAQTFIPLEIRRNAIVDVAIIVSDNHLVNPPYGFTKIDFDLNRGAKGKFIYLCYKQQKISVAGSPADPKPITALNVVSSDYHDPSAPSGYTMINTDLNQGAKGKFIYLCYTKDPAAIPSDEDGLPIRGLRVIGNPQVENVVTPYGFTRINKDLNEGAKGEFIYVCFSRHLD

SEQ ID NO: 79 - DNA, 1353 bp, Huperzia carinata
atggcccaaatcaagccactacctggatctgattcagtcggacacaattatgatgtattcggattctttgccaaccccaagagcgtgaaaagacagctctttgactttgcccctcaggaagaaattactttagagggccacacttggctcctttccactgatattgaatatactattgtccgagatatggagataaaaactctctcttatcgcacaaaagatgcatactccacggagctggctgcaagcgtaaaagtgtccggcagctatggcggcttctcggcttcggtagagtctgatttctcccaaagcatcagccaggagacggactccacttacacttcagttcgtacaaatgtgaccaaatggaagctcggtctcaagccaactgtcgaagaactgcgttccatgttgacgccttcgttcaaggaggcattggcgagtatggagtcggaggagctgtttacgacgtacgggacatattatctgagtgaggtgttggtgggaggtcgcgcagattacgtggccaccaccaaaaccagtgcattcagctctgatactcaaatcagcgtagttgcggagagttcattcaagtccgtggctggcatggaggtatcctcccagtacaaggagcttatcaagaaatttcaagagaacagctccactcgtctgtacgccatcggtgggaccgcactctccagcatcacagacacggccacttacaacgcatggctcagttcgattgatacacttcccgtcttctgtggattcactagcgcaagtcttaagcccatctgggaactcgctgaatcctctcagcgccaggagatcctgcaaaaggctgcgcagacctttatcccgctcgaaatcagacgaaatgcgatcgttgacgtagctattatcgtgtccgacaaccatctggtgaatcctccctacggctttacgaagatcgattttgatctgaaccgcggtgccaagggcaaatttatctatttgtgctacaagcaacagaagatatcagtagcaggatcccctgcggatccgaaacccatcactgccttgaacgtggtttctagcgattaccatgatccatccgctccttcaggttataccatgatcaacacagatctgaaccagggtgcgaagggcaagtttatctatctctgctacacaaaagatccggctgcaatacccagcgacgaggatggactgcccatacgtggcctccgcgttattggtaacccacaagtcgagaatgtggttacaccttacggattcacgaggatcaataaagatctgaatgagggtgcaaagggagagtttatctacgtttgtttctcacgtcatttagac

SEQ ID NO: 80 - protein, 451 aa, Huperzia carinata
MAQIKPLPGSDSVGHNYDVFGFFANPKSVKRQLFDFAPQEEITLEGHTWLLSTDIEYTIVRDMEIKTLSYRTKDAYSTELAASVKVSGSYGGFSASVESDFSQSISQETDSTYTSVRTNVTKWKLGLKPTVEELRSMLTPSFKEALASMESEELFTTYGTYYLSEVLVGGRADYVATTKTSAFSSDTQISVVAESSFKSVAGMEVSSQYKELIKKFQENSSTRLYAIGGTALSSITDTATYNAWLSSIDTLPVFCGFTSASLKPIWELAESSQRQEILQKAAQTFIPLEIRRNAIVDVAIIVSDNHLVNPPYGFTKIDFDLNRGAKGKFIYLCYKQQKISVAGSPADPKPITALNVVSSDYHDPSAPSGYTMINTDLNQGAKGKFIYLCYTKDPAAIPSDEDGLPIRGLRVIGNPQVENVVTPYGFTRINKDLNEGAKGEFIYVCFSRHLD

SEQ ID NO: 81 - DNA, 1353 bp, Huperzia carinata
atggcccaaatcgagccattacctggatcggatgcaatcggacacagttatgatgtattcggattctatgccaaccccaagagcgtgaaaagagagctcttcgactttgcccctcagcaagaaattactgaagagggccacacttggctcctttccactgatattgtaaatactgctgtccgagatacggaaataaaaaccgtctctcttcgcacaaaagatgaatactccacggagctggctgcaagcgtaaaagtgtccggcagctatggcggcttctcggcttcggtagagtctgatttctcccaaagcatcagccaggagacggactccacttacacttcagttcgtacaaatgtgaccaaatggaagctcggtctcaagccaactgtcgaagaactgcgttccatgttgacgccttcgttcaaggaggcattggcgagtatggagtcggaggagctgtttacgacgtacgggacatattatctgagtgaggtgttggtgggaggtcgcgcagattacgtggccaccaccaaaaccagtgcattcagctctgatactcaaatcagcgtagttgcggagagttcattcaagtccgtggctggcatggaggtatcctcccagtacaaggagcttatcaagaaatttcaagagaacagctccactcgtctgtacgccatcggtgggaccgcactctccagcatcacagacacggccacttacaacgcatggctcagttcgattgatacacttcccgtcttctgtggattcactagcgcaagtcttaagcccatctgggaactcgctgaatcctctcagcgccaggagatcctgcaaaaggctgcgcagacctttatcccgctcgaaatcagacgaaatgcgatcgttgacgtagctattatcgtgtccgacaaccatctggtgaatcctccctacggctttacgaagatcgattttgatctgaaccgcggtgccaagggcaaatttatctatttgtgctacaagcaacagaagatatcagtagcaggatcccctgcggatccgaaacccatcactgccttgaacgtggtttctagcgattaccatgatccatccgctccttcaggttataccatgatcaacacagatctgaaccagggtgcgaagggcaagtttatctatctctgctacacaaaagatccggctgcaatacccagcgacgaggatggactgcccatacgtggcctccgcgttattggtaacccacaagtcgagaatgtggttacaccttacggattcacgaggatcaataaagatctgaatgagggtgcaaagggagagtttatctacgtttgtttctcacgtcatttagac

SEQ ID NO: 82 - protein, 451 aa, Huperzia carinata
MAQIEPLPGSDAIGHSYDVFGFYANPKSVKRELFDFAPQQEITEEGHTWLLSTDIVNTAVRDTEIKTVSLRTKDEYSTELAASVKVSGSYGGFSASVESDFSQSISQETDSTYTSVRTNVTKWKLGLKPTVEELRSMLTPSFKEALASMESEELFTTYGTYYLSEVLVGGRADYVATTKTSAFSSDTQISVVAESSFKSVAGMEVSSQYKELIKKFQENSSTRLYAIGGTALSSITDTATYNAWLSSIDTLPVFCGFTSASLKPIWELAESSQRQEILQKAAQTFIPLEIRRNAIVDVAIIVSDNHLVNPPYGFTKIDFDLNRGAKGKFIYLCYKQQKISVAGSPADPKPITALNVVSSDYHDPSAPSGYTMINTDLNQGAKGKFIYLCYTKDPAAIPSDEDGLPIRGLRVIGNPQVENVVTPYGFTRINKDLNEGAKGEFIYVCFSRHLD

SEQ ID NO: 83 - DNA, 1353 bp, Huperzia carinata
atggcccaaatagagccattacctggatcggatgcaatcggacacagttatgatgtattcggattctttgccagccccaagagcgtgaaaagacatctcttcgactttgcccctcaggaagaaattactttagaggaccacgattggctcctttccactgatattgaatatactgctgtccgagatacggatatcaaaaccatctcttatcgcacaaaagatgcatactccagggatctggctgcaagcgtaaaaatgtccggcggctatggcggcttttcggcttcggtggagtccgatttctcccaaagcatcagccaggagacggactccacttacacttcagttcgtacaaatgtgacgaaatggaagctcagactcaagccaactgtggaagaactgcgttccatgttgacgccttcgttcaaggaggcattggcaagtatggactcggaggagctgttttcgacgtacgggacatattatctgagtgaggtgttggtgggaggtcgcgcagattacgtggccaccaccaaaaccagtgcattcagctctgatactcaaatcagcgtagttgcggagagttcattcaagtccgtggctggcatggaggtatcctcccagtacaaggagcttatcaagaaatttcaagagaacagctccactcgtctgtacgccatcggtgggaccgcactctccagcatcacagacacggccacttacaacgcatggctcagttcgattgatacacttcccgtcttctgtggattcactagcgcaagtcttaagcccatctgggaactcgctgaatcctctcagcgccaggagatcctgcaaaaggctgcgcagacctttatcccgctcgaaatcagacgaaatgcgatcgttgacgtagctattatcgtgtccgacaaccatctggtgaatcctccctacggctttacgaagatcgattttgatctgaaccgcggtgccaagggcaaatttatctatttgtgctacaagcaacagaagatatcagtagcaggatcccctgcggatccgaaacccatcactgccttgaacgtggtttctagcgattaccatgatccatccgctccttcaggttataccatgatcaacacagatctgaaccagggtgcgaagggcaagtttatctatctctgctacacaaaagatccggctgcaatacccagcgacgaggatggactgcccatacgtggcctccgcgttattggtaacccacaagtcgagaatgtggttacaccttacggattcacgaggattaataaagatctgaatgagggtgcaaagggagagtatatctacgtttgtttctcacgtcatttagac

SEQ ID NO: 84 - protein, 451 aa, Huperzia carinata
MAQIEPLPGSDAIGHSYDVFGFFASPKSVKRHLFDFAPQEEITLEDHDWLLSTDIEYTAVRDTDIKTISYRTKDAYSRDLAASVKMSGGYGGFSASVESDFSQSISQETDSTYTSVRTNVTKWKLRLKPTVEELRSMLTPSFKEALASMDSEELFSTYGTYYLSEVLVGGRADYVATTKTSAFSSDTQISVVAESSFKSVAGMEVSSQYKELIKKFQENSSTRLYAIGGTALSSITDTATYNAWLSSIDTLPVFCGFTSASLKPIWELAESSQRQEILQKAAQTFIPLEIRRNAIVDVAIIVSDNHLVNPPYGFTKIDFDLNRGAKGKFIYLCYKQQKISVAGSPADPKPITALNVVSSDYHDPSAPSGYTMINTDLNQGAKGKFIYLCYTKDPAAIPSDEDGLPIRGLRVIGNPQVENVVTPYGFTRINKDLNEGAKGEYIYVCFSRHLD

SEQ ID NO: 85 - DNA, 1353 bp, Huperzia carinata
atggtgaatatcgagccattaccaggatcggatgcaatcggacacagttatgatgtgttcggattttatgccaatcccaagagcgtaaagaaagagcttttcgactttgccgtccagaaagaaatcacttcagagggccacacttggctcctttccactgatattaaatatattgcagtcagagatacggaaataaaaaccttctcccttcgcacaaaagatgcatactcaagcgagctggctaaaagcgtaaaactgtccggcagctacggcggcttctcggaatcggtagagtcagacttctccgaaagcatcagcgatgagacggattccacatacacttcagttcgtacaaatgtgaacaagtggaagatcagtctgaagcacagtgtggaaaagctgcgctccctgttgaagcctgcgttgaaggagccattggcgagtatgaacgcggtggagctgttgagtacgtatgggacacattatctgggcgaggtgttggtgggaggtcgtgcagattttgtggccaccaccaaaaccagtgcattcagctcggacactaaaatcagcatagtagcggagagttctttcaagtccgtggctggcatgaaagtatccgcggagcaaaagcagcttatcgaaaacttccaagaaaacagctccactagtctgtacgccatcggtgggagcgcactctccagcatcacagacacggccacttacaacgcatggctcagttccattgatacacgtcccgtcttctgtggattcactcgcgacagtcttaggcccatctgggagctcgctgaatcccctcagcgccgggagattctccgaaaagctacccaaacgtttatcccaccagaaatcacacgaaatgcaatcgttggcgtagatattatcatgtctgacaactattgggtgaatcctccctacggctatacgaagatcgattatgatctgaaccgcaatgccaagggcaaatatatcttcttgtgttacaaacaacagaagatatcagtagctggatccccagcggatcccaagcccatcactgccttgtacgtggcttctggcgatgatgataatccatatgttcccgcaggttacaccaagatcgacaaagatttgaacaaagatgctgggggcaagtttatctatctctgttacacaaaagatccggctgcaatacccaacgacgaggatggactgcccatacgtggcatccgcgttatcggcaatgaaaaacttgagaatgtggttaccccgtatggattcacgaggattgatgaagatctgaataagggtgcaaagggagactatatcttcgtttgtttctcacgtcatttagac

SEQ ID NO: 86 - protein, 451 aa, Huperzia carinata
MVNIEPLPGSDAIGHSYDVFGFYANPKSVKKELFDFAVQKEITSEGHTWLLSTDIKYIAVRDTEIKTFSLRTKDAYSSELAKSVKLSGSYGGFSESVESDFSESISDETDSTYTSVRTNVNKWKISLKHSVEKLRSLLKPALKEPLASMNAVELLSTYGTHYLGEVLVGGRADFVATTKTSAFSSDTKISIVAESSFKSVAGMKVSAEQKQLIENFQENSSTSLYAIGGSALSSITDTATYNAWLSSIDTRPVFCGFTRDSLRPIWELAESPQRREILRKATQTFIPPEITRNAIVGVDIIMSDNYWVNPPYGYTKIDYDLNRNAKGKYIFLCYKQQKISVAGSPADPKPITALYVASGDDDNPYVPAGYTKIDKDLNKDAGGKFIYLCYTKDPAAIPNDEDGLPIRGIRVIGNEKLENVVTPYGFTRIDEDLNKGAKGDYIFVCFSRHLD

SEQ ID NO: 87 - DNA, 1353 bp, Huperzia carinata
atggtgaatatcgagccattaccaggatcggatgcaatcggacacagttatgatgtgttcggattttatgccaatcccaagagcgtaaagaaagagcttttcgactttgccgtccagaaagaaatcacttcagagggccacacttggctcctttccactgatattaaatatattgcagtcagagatacggaaataaaaaccttctcccttcgcacaaaagatgcatactcaagcgagctggctaaaagcgtaaaactgtccggcagctacggcggcttctcggaatcggtagagtcagacttctccgaaagcatcagcgatgagacggattccacatacacttcagttcgtacaaatgtgaacaagtggaagatcagtctgaagcacagtgtggaaaagctgcgctccctgttgaagcctgcgttgaaggagccattggcgagtatgaacgcggtggagctgttgagtacgtatgggacacattatctgggcgaggtgttggtgggaggtcgtgcagattttgtggccaccaccaaaaccagtgcattcagctcggacactaaaatcagcatagtagcggagagttctttcaagtccgtggctggcatgaaagtatccgcggagcaaaagcagcttatcgaaaacttccaagaaaacagctccactagtctgtacgccatcggtgagagcgcactctccagcatcacagacacggccacttacaacgcatggctcagttccattgatacacgtcccgtcttctgtggattcactcgcgacagtcttaggcccatctgggagctcgctgaatcccctcagcgccgggagattctccgaaaagctacccaaacgtttatcccaccagaaatcacacgaaatgcaatcgttggcgtagatattatcatgtctgacaactattgggtgaatcctccctacggctatacgaagatcgattatgatctgaaccgcaatgccaagggcaaatatatcttcttgtgttacaaacaacagaagatatcagtagctggatccccagcggatcccaagcccatcactgccttgtacgtggcttctggcgatgatgataatccatatgttcccgcaggttacaccaagatcgacaaagatttgaacaaagatgctgggggcaagtttatctatctctgttacacaaaagatccggctgcaatacccaacgacgaggatggactgcccatacgtggcatccgcgttatcggcaatgaaaaacttgagaatgtggttaccccgtatggattcacgaggattgatgaagatctgaataagggtgcaaagggagactatatcttcgtttgtttctcacgtcatttagac

SEQ ID NO: 88 - protein, 451 aa, Huperzia carinata
MVNIEPLPGSDAIGHSYDVFGFYANPKSVKKELFDFAVQKEITSEGHTWLLSTDIKYIAVRDTEIKTFSLRTKDAYSSELAKSVKLSGSYGGFSESVESDFSESISDETDSTYTSVRTNVNKWKISLKHSVEKLRSLLKPALKEPLASMNAVELLSTYGTHYLGEVLVGGRADFVATTKTSAFSSDTKISIVAESSFKSVAGMKVSAEQKQLIENFQENSSTSLYAIGESALSSITDTATYNAWLSSIDTRPVFCGFTRDSLRPIWELAESPQRREILRKATQTFIPPEITRNAIVGVDIIMSDNYWVNPPYGYTKIDYDLNRNAKGKYIFLCYKQQKISVAGSPADPKPITALYVASGDDDNPYVPAGYTKIDKDLNKDAGGKFIYLCYTKDPAAIPNDEDGLPIRGIRVIGNEKLENVVTPYGFTRIDEDLNKGAKGDYIFVCFSRHLD

SEQ ID NO: 89 - DNA, 1353 bp, Huperzia carinata
atggtgaatatcgagccattaccaggatcggatgcaatcggacacagttatgatgtgttcggattttatgccaatcccaagagcgtaaagaaagagcttttcgactttgccgtccagaaagaaatcacttcagagggccacacttggctcctttccactgatattaaatatattgcagtcagagatacggaaataaaaaccttctcccttcgcacaaaagatgcatactcaagcgagctggctaaaagcgtaaaactgtccggcagctacggcggcttctcggaatcggtagagtcagacttctccgaaagcatcagcgatgagacggattccacatacacttcagttcgtacaaatgtgaacaagtggaagatcagtctgaagcacagtgtggaaaagctgcgctccctgttgaagcctgcgttgaaggagccattggcgagtatgaacgcggtggagctgttgagtacgtatgggacacattatctgggcgaggtgttggtgggaggtcgtgcagattatgtggccaccaccaaaaccagtgcattcagctccagcactaaaatcagcacagtagcggagagttctttcaaatccatggctggcatgaaggtatctgccgcgcacatgcagcttatccagaaattccaagagaacagctccactagtctgtacgccatcggtggcagcgctctctccaacatcacagatgcgaccacttacaatgcatggctccgttcaattgatacgcgtcccgtcttctgtggattcactcgcgacagtcttaggcccatctgggaactcgctgaatcccctcagcgccgggagattctccgaaaagctacccaaacgtttatcccatccggaatcacacgaaatgcaatcgttggcatagatattatcatctcagacagctattgggtgaatcctccctacggctatacgaagatcaattatgatctgaaccgcaatgccaagggcaaatatatcttcttgtgttacaaacaacagaaaatatcagtagctgaatccccagcggatccgaagcccatcactgccttgtacgtgagttccggagatgatgataatccatacgttccaccaggttacaccaagatcaacaaagatctgaacaagggtgctgggggaaagtttatctatctctgttacacaaaagatccggctgcaatacccagccacgaggatggactgcccatacgtggcatccgcgttattggtaacgaaaaactggagaacgtggttacaccttacggatacacgaggattgatgaagatctgaacaagggtgcaggtggagactatatcttcgtttgtttctcacgtcatttagac

SEQ ID NO: 90 - protein, 451 aa, Huperzia carinata
MVNIEPLPGSDAIGHSYDVFGFYANPKSVKKELFDFAVQKEITSEGHTWLLSTDIKYIAVRDTEIKTFSLRTKDAYSSELAKSVKLSGSYGGFSESVESDFSESISDETDSTYTSVRTNVNKWKISLKHSVEKLRSLLKPALKEPLASMNAVELLSTYGTHYLGEVLVGGRADYVATTKTSAFSSSTKISTVAESSFKSMAGMKVSAAHMQLIQKFQENSSTSLYAIGGSALSNITDATTYNAWLRSIDTRPVFCGFTRDSLRPIWELAESPQRREILRKATQTFIPSGITRNAIVGIDIIISDSYWVNPPYGYTKINYDLNRNAKGKYIFLCYKQQKISVAESPADPKPITALYVSSGDDDNPYVPPGYTKINKDLNKGAGGKFIYLCYTKDPAAIPSHEDGLPIRGIRVIGNEKLENVVTPYGYTRIDEDLNKGAGGDYIFVCFSRHLD

SEQ ID NO: 91 - DNA, 1353 bp, Huperzia carinata
atggtgaatatcgagccattaccaggatcggatgcaatcggacacagttatgatgtgttcggattttatgccaatctcaagagcgtaaagaaagagcttttcgactttgccgtccagaaagaaatcacttcagagggccacacttggctcctttccactgatattaaatatattgcagtcagagatacggaaataaaaaccttctcccttcgcacaaaagatgcatactcaagcgagctggctaaaagcgtaaaactgtccggcagctacggcggcttctcggaatcggtagagtcagacttctccgaaagcatcagcgatgagacggattccacatacacttcagttcgtacaaatgtgaacaagtggaagatcagtctgaagcacagtgtggaaaagctgcgctccctgttgaagcctgcgttgaaggagccattggcgagtatgaacgcggtggagctgttgagtacgtatgggacacattatctgggcgaggtgttggtgggaggtcgtgcagattatgtggccaccaccaaaaccagtgcattcagctccagcactaaaatcagcacagtagcggagagttctttcaaatccatggctggcatgaaggtatctgccgcgcacatgcagcttatccagaaattccaagagaacagctccactagtctgtacgccatcggtggcagcgctctctccaacatcacagatgcgaccacttacaatgcatggctccgttcaattgatacgcgtcccgtcttctgtggattcactcgcgacagtcttaggcccatctgggaactcgctgaatcccctcagcgccgggagattcttcgaaaagctacccaaacgtttatcccatccggaatcacacgaaatgcaatcgttggcatagatattatcatctcagacagctattgggtgaatcctccctacggctatacgaagatcaattatgatctgaaccgcaatgccaagggcaaatatatcttcttgtgttacaaacaacagaaaatatcagtagctgaatccccagcggatccgaagcccatcactgccttgtacgtgagttccggagatgatgataatccatacgttccaccaggttacaccaagatcaacaaagatctgaacaagggtgctgggggaaagtttatctatctctgttacacaaaagatccggctgcaatacccagccacgaggatggactgcccatacgtggcatccgcgttattggtaacgaaaaactggagaacgtggttacaccttacggatacacgaggattgatgaagatctgaacaagggtgcaggtggagactatatcttcgtttgtttctcacgtcatttagac

SEQ ID NO: 92 - protein, 451 aa, Huperzia carinata
MVNIEPLPGSDAIGHSYDVFGFYANLKSVKKELFDFAVQKEITSEGHTWLLSTDIKYIAVRDTEIKTFSLRTKDAYSSELAKSVKLSGSYGGFSESVESDFSESISDETDSTYTSVRTNVNKWKISLKHSVEKLRSLLKPALKEPLASMNAVELLSTYGTHYLGEVLVGGRADYVATTKTSAFSSSTKISTVAESSFKSMAGMKVSAAHMQLIQKFQENSSTSLYAIGGSALSNITDATTYNAWLRSIDTRPVFCGFTRDSLRPIWELAESPQRREILRKATQTFIPSGITRNAIVGIDIIISDSYWVNPPYGYTKINYDLNRNAKGKYIFLCYKQQKISVAESPADPKPITALYVSSGDDDNPYVPPGYTKINKDLNKGAGGKFIYLCYTKDPAAIPSHEDGLPIRGIRVIGNEKLENVVTPYGYTRIDEDLNKGAGGDYIFVCFSRHLD

SEQ ID NO: 93 - DNA, 1353 bp, Huperzia carinata
atggtgaatatcgagccattaccaggatcggatgcaatcggacacagttatgatgtgttcggattttatgccaatcccaagagcgtaaagaaagagcttttcgactttgccgtccagaaagaaatcacttcagagggccacacttggctcctttccactgatattaaatatattgcagtcagagatacggaaataaaaaccttctcccttcgcacaaaagatgcatactcaagcgagctggctaaaagcgtaaaactgtccggcagctacggcggcttctcggaatcggtagagtcagacttctccgaaagcatcagcgatgagacggattccacatacacttcagttcgtacaaatgtgaacaagtggaagatcagtctgaagcacagtgtggaaaagctgcgctccctgttgaagcctgcgttgaaggagccattggcgagtatgaacgcggtggagctgttgagtacgtatgggacacattatctgggcgaggtgttggtgggaggtcgtgcagattatgtggccaccaccaaaaccagtgcattcagctccagcactaaaatcagcacagtagcggagagttttttcaaatccatggctggcatgaaggtatctgccgcgcacatgcagcttatccagaaattccaagagaacagctccactagtctgtacgccatcggtggcagcgctctctccaacatcacagatgcgaccacttacaatgcatggctccgttcaattgatacgcgtcccgtcttctgtggattcactcgcgacagtcttaggcccatctgggaactcgctgaatcccctcagcgccgggagattctccgaaaagctacccaaacgtttatcccatccggaatcacacgaaatgcaatcgttggcatagatattatcatctcagacagctattgggtgaatcctccctacggctatacgaagatcaattatgatctgaaccgcaatgccaagggcaaatatatcttcttgtgttacaaacaacagaaaatatcagtagctgaatccccagcggatccgaagcccatcactgccttgtacgtgagttccggagatgatgataatccatacgttccaccaggttacaccaagatcaacaaagatctgaacaagggtgctgggggaaagtttatctatctctgttacacaaaagatccggctgcaatacccagccacgaggatggactgcccatacgtggcatccgcgttattggtaacgaaaaactggagaacgtggttacaccttacggatacacgaggattgatgaagatctgaacaagggtgcaggtggagactatatcttcgtttgtttctcacgtcatttagac

SEQ ID NO: 94 - protein, 451 aa, Huperzia carinata
MVNIEPLPGSDAIGHSYDVFGFYANPKSVKKELFDFAVQKEITSEGHTWLLSTDIKYIAVRDTEIKTFSLRTKDAYSSELAKSVKLSGSYGGFSESVESDFSESISDETDSTYTSVRTNVNKWKISLKHSVEKLRSLLKPALKEPLASMNAVELLSTYGTHYLGEVLVGGRADYVATTKTSAFSSSTKISTVAESFFKSMAGMKVSAAHMQLIQKFQENSSTSLYAIGGSALSNITDATTYNAWLRSIDTRPVFCGFTRDSLRPIWELAESPQRREILRKATQTFIPSGITRNAIVGIDIIISDSYWVNPPYGYTKINYDLNRNAKGKYIFLCYKQQKISVAESPADPKPITALYVSSGDDDNPYVPPGYTKINKDLNKGAGGKFIYLCYTKDPAAIPSHEDGLPIRGIRVIGNEKLENVVTPYGYTRIDEDLNKGAGGDYIFVCFSRHLD

SEQ ID NO: 95 - DNA, 1434 bp, Ophioglossum pendulum; identical to SEQ ID NO: 57

SEQ ID NO: 96 - protein, 478 aa, Ophioglossum pendulum; identical to SEQ ID NO: 58

SEQ ID NO: 97 - DNA, 1434 bp, Ophioglossum pendulum
atggaacccaacaaaggtggtgctccagccatgaaaaatgtagccaaaccttccacaaagagactcataccgtcatccattgctgcatcatcgcaaacatctgcaaatgcattaaccgagccattgcctggctctgatgccatcggccagagctacgatgcgttcgggttcttcgccaatcccagaagcatcatgaaggagttgtttgagttcagtcctcaagaggagatagtcgtggaaggaaatacctggcttctctcttcggacttcgtttacaccgcaattagagacactgagacctccacggtctcacgtcgcaccaaggacgactactccaaggaattggctgtgaaggtgaagctgtctggaagctatggctatttttctgcctccgttgagtctgatttctctcagagcatttccgatgcgacggacaccacatacacttcagttcgcacccacgtcaacaagtggaggctgagcctgaaggacgatgttggggcccttcgctcgaagctgctgcctggcttcaagcaggcgctggctaccatggatgctacgcagctctttgacacgttcgggactcactatgtgagcgaggtgcttgtgggtgggcgtgcagactacgttgccaccaccaagaccagcgcgttcagctcatccaccagcatcagcgtagcggcagaagcatcattccagtccatcgcgggtggggaggtgtctccggagtccaaggtgcttgcggagatgctgagagagaacagcagcacacgcctgtacgctcttggcgggagtgccctccccaacatcacagatccagccacgtacaacgcctggctggagtccattgacaccatccctgtcttctgcggattcactcaaaacagcctcaagcccatctcggagcttgctgactccgctcaacgccgggacgctctggccaaagcctcccaaagctatatcccatcatacgtgactcgtcctgcagtggttggcttggaggtcataatatcggacagcaactcggagagccctccctatggctacaccagaatagactacgacctcaaccgcaacgcaggaggcaaatacgtgttcctctgctacaagcagaagaacatttcagtgggaggggatgccgatgccatcaccgacgtccttgtcgtctacggaaatgaccgaaatccatctgtgccgtctggctacaccaagatcgacaaggacctcaactccggggcaggcggtaagtatatctacttctgctactccaaggacaagcggaagcaagaggagggactgcccattcgtgggcttcgtgttgttgggcctcacccaacctcagtggcaccttacggattctctaagatcgacatagatctgaatatgggtgcaggaggagattttatatacctttgcaaatcacgccatttggag

SEQ ID NO: 98 - protein, 478 aa, Ophioglossum pendulum
MEPNKGGAPAMKNVAKPSTKRLIPSSIAASSQTSANALTEPLPGSDAIGQSYDAFGFFANPRSIMKELFEFSPQEEIVVEGNTWLLSSDFVYTAIRDTETSTVSRRTKDDYSKELAVKVKLSGSYGYFSASVESDFSQSISDATDTTYTSVRTHVNKWRLSLKDDVGALRSKLLPGFKQALATMDATQLFDTFGTHYVSEVLVGGRADYVATTKTSAFSSSTSISVAAEASFQSIAGGEVSPESKVLAEMLRENSSTRLYALGGSALPNITDPATYNAWLESIDTIPVFCGFTQNSLKPISELADSAQRRDALAKASQSYIPSYVTRPAVVGLEVIISDSNSESPPYGYTRIDYDLNRNAGGKYVFLCYKQKNISVGGDADAITDVLVVYGNDRNPSVPSGYTKIDKDLNSGAGGKYIYFCYSKDKRKQEEGLPIRGLRVVGPHPTSVAPYGFSKIDIDLNMGAGGDFIYLCKSRHLE

SEQ ID NO: 99 - DNA, 1434 bp, Ophioglossum pendulum
atggaacccaacaaaggtggtgctccagccatgaaaaatgtagccaaaccttccacaaagagactcataccgtcatccattgctgcatcatcgcaaacatctgcaaatgcattaaccgagccattgcctggctctgatgccatcggccagagctacgatgcgttcgggttcttcgccaatcccagaagcatcatgaaggagttgtttgagttcagtcctcaagaggagatagtcgtggaaggaaatacctggcttctctcttcggacttcgtttacaccgcaattagagacactgagacctccacggtctcacgtcgcaccaaggacgactactccaaggaattggctgtgaaggtgaagctgtctggaagctatggctttttttctgcctccgttgagtctgatttctctcagagcatttccgatgcgacggacaccacatacacttcagttcgcacccacgtcaacaagtggaggctgagcctgaaggacgatgttggggcccttcgctcgaagctgctgcctggcgtcaagcaggcgctggctaccatggatgctacgcagctctttgacacgttcgggactcactatgtgagcgaggtgcttgtgggtgggcgtgcagactacgttgccaccaccaagaccagcgcgttcagctcatccaccagcatcagcgtagcggcagaagcatcattccagtccatcgcgggtggggaggtgtctccggagtccaaggtgcttgcggagatgctgagagagaacagcagcacacgcctgtacgctcttggcgggagtgccctccccaacatcacagatccagccacgtacaacgcctggctggagtccattgacaccatccctgtcttctgcggattcactcaaaacagcctcaagcccatctcggagcttgctgactccgctcaacgccgggacgctctggccaaagcctcccaaagctatatcccatcatacgtgactcgtcctgcagtggttggcttggaggtcataatatcggacagcaactcggagagccctccctatggctacaccagaatagactacgacctcaaccgcaacgcaggaggcaaatacgtgttcctctgctacaagcagaagaacatttcagtgggaggggatgccgatgccatcaccgacgtccttgtcgtctacggaaatgaccgaaatccatctgtgccgtctggctacaccaagatcgacaaggacctcaactccggggcaggcggtaagtatatctacttctgctactccaaggacaagcggaagcaagaggagggactgcctattcgtgggcttcgtgttgttgggcctcacccaacctcagtggcaccttacggattctctaagatcgacatagatctgaatatgggtgcaggaggagattttatatacctttgcaaatcacgccatttggag

SEQ ID NO: 100 - protein, 478 aa, Ophioglossum pendulum
MEPNKGGAPAMKNVAKPSTKRLIPSSIAASSQTSANALTEPLPGSDAIGQSYDAFGFFANPRSIMKELFEFSPQEEIVVEGNTWLLSSDFVYTAIRDTETSTVSRRTKDDYSKELAVKVKLSGSYGFFSASVESDFSQSISDATDTTYTSVRTHVNKWRLSLKDDVGALRSKLLPGVKQALATMDATQLFDTFGTHYVSEVLVGGRADYVATTKTSAFSSSTSISVAAEASFQSIAGGEVSPESKVLAEMLRENSSTRLYALGGSALPNITDPATYNAWLESIDTIPVFCGFTQNSLKPISELADSAQRRDALAKASQSYIPSYVTRPAVVGLEVIISDSNSESPPYGYTRIDYDLNRNAGGKYVFLCYKQKNISVGGDADAITDVLVVYGNDRNPSVPSGYTKIDKDLNSGAGGKYIYFCYSKDKRKQEEGLPIRGLRVVGPHPTSVAPYGFSKIDIDLNMGAGGDFIYLCKSRHLE

SEQ ID NO: 101 - DNA, 1434 bp, Ophioglossum pendulum
atggaacccaacaaaggtggtgctccagccatgaaaaatgtagccaaaccttccacaaagagactcataccgtcatccattgctgcatcatcgcaaacatctgcaaatgcattaaccgagccattgcctggctctgatgccatcggccagagctacgatgcattcgggttcttcgccaatcccagaagcatcatgaaggagttgtttgagttcagtcctcaagaggagatagtcgtggaaggaaatacctggcttctctcttcggacttcgtttacaccgcaattagagacactgagacctccacggtctcacgtcgcaccaaggacgactactccaaggaattggctgtgaaggtgaagctgtctggaagctatggctttttttctgcctccgttgagtctgatttctctcagagcatttccgatgtgacggacaccacatacacttcagttcgcacccacgtcaacaagtggaggctgagcctgaaggacgatgttggggcccttcgctcgaagctgctgcctggcttcaagcaggcgctggctaccatggatgctacgcagctctttgacacgttcgggactcactatgtgagcgaggtgcttgtgggtgggcgtgcagactacgttgccaccaccaagaccagcgcgttcagctcatccaccagcatcagcgtagcggcagaagcatcattccagtccatcgcgggtggggaggtgtctccggagtccaaggagcttgcggagacgctgagagagaacagcagcacacgcctgtacgctcttggcgggagtgccctccccaacatcacagatccagccacgtacaacgcctggctggagtccattgacaccatccctgtcttctgcggattcactcaaaacagcctcaagcccatctcggagcttgctgactccgctcaacgccgggacgctctggccaaagcctcccaaagctatatcccatcatacgtgactcgtcctgcagtggttggcttggaggtcataatatcggacagcaactcggagagccctccctatggctacaccagaatagactacgacctcaaccgcaacgcaggaggcaaatacgtgttcctctgctacaagcagaagaacatttcagtgggaggggatgccgatgccatcaccgacgtccttgtcgtctacggaaatgaccgaaatccatctgtgccgtctggctacaccaagatcgacaaggacctcaactccggggcaggcggtaagtatatctacttctgctactccaaggacaagcggaagcaagaggagggactgcccattcgtgggcttcgtgttgttgggcctcacccaacctcagtggcaccttacggattctctaagatcgacatagatctgaatatgggtgcaggaggagattttatatacctttgcaaatcacgccatttggag

SEQ ID NO: 102 - protein, 478 aa, Ophioglossum pendulum
MEPNKGGAPAMKNVAKPSTKRLIPSSIAASSQTSANALTEPLPGSDAIGQSYDAFGFFANPRSIMKELFEFSPQEEIVVEGNTWLLSSDFVYTAIRDTETSTVSRRTKDDYSKELAVKVKLSGSYGFFSASVESDFSQSISDVTDTTYTSVRTHVNKWRLSLKDDVGALRSKLLPGFKQALATMDATQLFDTFGTHYVSEVLVGGRADYVATTKTSAFSSSTSISVAAEASFQSIAGGEVSPESKELAETLRENSSTRLYALGGSALPNITDPATYNAWLESIDTIPVFCGFTQNSLKPISELADSAQRRDALAKASQSYIPSYVTRPAVVGLEVIISDSNSESPPYGYTRIDYDLNRNAGGKYVFLCYKQKNISVGGDADAITDVLVVYGNDRNPSVPSGYTKIDKDLNSGAGGKYIYFCYSKDKRKQEEGLPIRGLRVVGPHPTSVAPYGFSKIDIDLNMGAGGDFIYLCKSRHLE

SEQ ID NO: 103 - DNA, 1434 bp, Ophioglossum pendulum
atggaacccaacaaaggtggtgctccagccatgaaaaatgtagccaaaccttccacaaagagactcataccgtcatccattgctgcatcatcgcaaacatctgcaaatgcattaaccgagccattgcctggctctgatgccatcggccagagctacgatgcgttcgggttcttcgccaatcccagaagcatcatgaaggagttgtttgagttcagtcctcaagaggagatagtcgtggaaggaaatacctggcttctctcttcggacttcgtttacaccgcaattagagacactgagacctccacggtctcacgtcgcaccaaggacgactactccaaggaattggctgtgaaggtgaagctgtctggaagctatggctatttttctgcctccgttgagtctgatttctctcagagcatttccgatgcgacggacaccacatacacttcagttcgcacccacgtcaacaagtggaggctgagcctgaaggacgatgttggggcccttcgctcgaagctgctgcctggcgtcaagcaggcgctggctaccatggatgctacgcagctctttgacacgttcgggactcactatgtgagcgaggtgcttgtgggtgggcgtgcagactacgttgccaccaccaagaccagcgcgttcagctcgtccaccagcatcagcgtagcggcagaagcatcattccagtccatcgcgggtggggaggtgtctccggagtccaaggtgcttgcggagatgctgagagagaacagcagcacacgcctgtacgctcttggcgggagtgccctccccaacatcacagatccagccacgtacaacgcctggctgcagtccattgacaccatccctgtcttctgcggattcactcaaaacagcctcaagcccatctcggagcttgctgactccggtcaacgccgggacgctctggccaaagcctcccaaagctatatcccatcatacgtgactcgtcctgcagtggttggcttggaggtcataatatcggacagcaactcggagagccctccctatggctacaccagaatagactacgacctcaaccgcaacgcaggaggcaaatacgtgttcctctgctacaagcagaagaacatttcagtgggaggggatgccgatgccatcaccgacgtccttgtcgtctacggaaatgaccgaaatccatctgtgccgtctggctacaccaagatcgacaaggacctcaactccggggcaggcggtaagtatatctacttctgctactccaaggacaagcggaagcaagaggagggactgcccattcgtgggcttcgtgttgttgggcctcacccaacctcagtggcaccttacggattctctaagatcgacatagatctgaatatgggtgcaggaggagattttatatacctttgcaaatcacgccatttggag

SEQ ID NO: 104 - protein, 478 aa, Ophioglossum pendulum
MEPNKGGAPAMKNVAKPSTKRLIPSSIAASSQTSANALTEPLPGSDAIGQSYDAFGFFANPRSIMKELFEFSPQEEIVVEGNTWLLSSDFVYTAIRDTETSTVSRRTKDDYSKELAVKVKLSGSYGYFSASVESDFSQSISDATDTTYTSVRTHVNKWRLSLKDDVGALRSKLLPGVKQALATMDATQLFDTFGTHYVSEVLVGGRADYVATTKTSAFSSSTSISVAAEASFQSIAGGEVSPESKVLAEMLRENSSTRLYALGGSALPNITDPATYNAWLQSIDTIPVFCGFTQNSLKPISELADSGQRRDALAKASQSYIPSYVTRPAVVGLEVIISDSNSESPPYGYTRIDYDLNRNAGGKYVFLCYKQKNISVGGDADAITDVLVVYGNDRNPSVPSGYTKIDKDLNSGAGGKYIYFCYSKDKRKQEEGLPIRGLRVVGPHPTSVAPYGFSKIDIDLNMGAGGDFIYLCKSRHLE

SEQ ID NO: 105 - DNA, 1434 bp, Ophioglossum pendulum
atggaacccaacaaaggtggtgctccagccatgaaaaatgtagccaaaccttccacaaagagactcataccgtcatccattgctgcatcatcgcaaacatctgcaaatgcattaaccgagccattgcctggctctgatgccatcggccagagctacgatgcattcgggttcttcgccaatcccagaagcatcatgaaggagttgttcgagttcagtcctcaagaggagatagtcgtggaaggaaatacctggcttctctcttcggacttcgtttacaccgcaattagagacactgagacctccacggtctcacgtcgcaccaaggacgactactccaaggaattggctctgaaggtgaagctgtctggaagctatggctttttttctgcctccgttgagtctgatttctctcagagcatttccgatgtgacggacaccacatacacttcagttcgcacccacgtcaacaagtggaggctgagcctgaaggacgatgttggggcccttcgctcgaagctgctgcctggcttcaagcaggcgctggctaccatggatgctacgcagctctttgacacgttcgggactcactatgtgagcgaggtgcttgtgggtgggcgtgcagactacgttgccaccaccaagaccagcgcgttcagctcatccaccagcatcagcgtagcggcagaagcatcattccagtccatcgcgggtggggaggtgtctccggagtccaaggtgcttgcggagacgctgagagagaacagcagcacacgcctgtacgctcttggcgggagtgccctccccaacatcacagatccagccacgtacaacgcctggctggagtccattgacaccatccctgtcttctgcggattcactcaaaacagcctcaagcccatctcggagcttgctgactccgctcaacgccgggacgctctggccaaagcctcccaaagctatatcccatcatacgtgactcgtcctgcagtggttggcttggaggtcataatatcggacagcaactcggagagccctccctatggctacaccagaatagactacgacctcaaccgcaacgcaggaggcaaatacgtgttcctctgctacaagcagaagaacatttcagtgggaggggatgccgatgccatcaccgacgtccttgtcgtctacggaaatgaccgaaatccatctgtgccgtctggctacaccaagatcgacaaggacctcaactccggggcaggcggtaagtatatctacttctgctactccaaggacaagcggaagcaagaggagggactgcctattcgtgggcttcgtgttgttgggcctcacccaacctcagtggcaccttacggattctctaagatcgacatagatctgaatatgggtgcaggaggagattttatatacctttgcaaatcacgccatttggag

SEQ ID NO: 106 - protein, 478 aa, Ophioglossum pendulum
MEPNKGGAPAMKNVAKPSTKRLIPSSIAASSQTSANALTEPLPGSDAIGQSYDAFGFFANPRSIMKELFEFSPQEEIVVEGNTWLLSSDFVYTAIRDTETSTVSRRTKDDYSKELALKVKLSGSYGFFSASVESDFSQSISDVTDTTYTSVRTHVNKWRLSLKDDVGALRSKLLPGFKQALATMDATQLFDTFGTHYVSEVLVGGRADYVATTKTSAFSSSTSISVAAEASFQSIAGGEVSPESKVLAETLRENSSTRLYALGGSALPNITDPATYNAWLESIDTIPVFCGFTQNSLKPISELADSAQRRDALAKASQSYIPSYVTRPAVVGLEVIISDSNSESPPYGYTRIDYDLNRNAGGKYVFLCYKQKNISVGGDADAITDVLVVYGNDRNPSVPSGYTKIDKDLNSGAGGKYIYFCYSKDKRKQEEGLPIRGLRVVGPHPTSVAPYGFSKIDIDLNMGAGGDFIYLCKSRHLE

SEQ ID NO: 107 - DNA, 1434 bp, Ophioglossum pendulum
atggaacccaacaaaggtggtgctccagccatgaaaaatgtagccaaaccttccacaaagagactcataccgtcatccattgctgcatcatcgcaaacatctgcaaatgcattaaccgagccattgcctggctctgatgccatcggccagagctacgatgcattcgggttcttcgccaatcccagaagcatcatgaaggagttgttcgagttcactcctcaagaggagatagtcgtggaaggaaatacctggcttctctcttcggacttcgtttacaccgcaattagagacactgagacctccacggtctcacgtcgcaccaaggacgactactccaaggaattggctgtgaaggtgaagctgtctggaagctatggctatttttctgcctccgttgagtctgatttctctcagagcatttccgatgcgacggacaccacatacacttcagttcgcacccacgtcaacaagtggaggctgagcctgaaggacgatgttggggcccttcgctcgaagctgctgcctggcttcaagcaggcgctggctaccatggatgctactcagctctttgacacgttcgggactcactatgtgagcgaggtgcttgtgggtgggcgtgcaaactacgttgccaccaccaagaccagcgcgttcagctcatccaccagcatcagcgtagcggcagaagcatcattccagtccatcgcgggtggggaggtgtctccggagtccaaggtgcttgcggagacgctgagagagaacagcagcacacgcctgtacgctcttggagggagtgccctccccaacatcacagatccagccacgtacaacgcctggctggagtccattgacaccatccctgtcttctgcggattcactcaaaacagcctcaagcccatctcggagcttgctgactccgctcaacgccgggacgctctggccaaagcctcccaaagctatatcccatcatacgtgactcgtcctgcagtggttggcttggaggtcataatatcggacagcaactcggagagccctccctatggctacaccagaatagactacgacctcaaccgcaacgcaggaggcaaatacgtgttcctctgctacaagcagaagaacatttcagtgggaggggatgccgatgccatcaccgacgtccttgtcgtctacggaaatgaccgaaatccatctgtgccgtctggctacaccaagatcgacaaggacctcaactccggggcaggcggtaagtatatctacttctgctactccaaggacaagcggaagcaagaggagggactgcccattcgtgggcttcgtgttgttgggcctcacccaacctcagtggcaccttacggattctctaagatcgacatagatctgaatatgggtgcaggaggagattttatatacctttgcaaatcacgccatttggag

SEQ ID NO: 108 - protein, 478 aa, Ophioglossum pendulum
MEPNKGGAPAMKNVAKPSTKRLIPSSIAASSQTSANALTEPLPGSDAIGQSYDAFGFFANPRSIMKELFEFTPQEEIVVEGNTWLLSSDFVYTAIRDTETSTVSRRTKDDYSKELAVKVKLSGSYGYFSASVESDFSQSISDATDTTYTSVRTHVNKWRLSLKDDVGALRSKLLPGFKQALATMDATQLFDTFGTHYVSEVLVGGRANYVATTKTSAFSSSTSISVAAEASFQSIAGGEVSPESKVLAETLRENSSTRLYALGGSALPNITDPATYNAWLESIDTIPVFCGFTQNSLKPISELADSAQRRDALAKASQSYIPSYVTRPAVVGLEVIISDSNSESPPYGYTRIDYDLNRNAGGKYVFLCYKQKNISVGGDADAITDVLVVYGNDRNPSVPSGYTKIDKDLNSGAGGKYIYFCYSKDKRKQEEGLPIRGLRVVGPHPTSVAPYGFSKIDIDLNMGAGGDFIYLCKSRHLE

SEQ ID NO: 109 - DNA, 1434 bp, Ophioglossum pendulum
atggaacccaacaaaggtggtgctccagccatgaaaaatgtagccaaaccttccacaaagagactcataccgtcatccattgctgcatcatcgcaaacatctgcaaatgcattaaccgagccattgcctggctctgatgccatcggccagagctacgatgcgttcgggttcttcgccaatcccagaagcatcatgaaggagttgtttgagttcagtcctcaagaggagatagtcgtggaaggaaatacctggcttctctcttcggacttcgtttacaccgcaattagagacactgagacctccacggtctcacgtcgcaccaaggacgactactccaaggaattggctgtgaaggtgaagctgtctggaagctatggctatttttctgcctccgttgagtctgatttctctcagagcatttccgatgcgacggacaccacatacacttcagttcgcacccacgtcaacaagtggaggctgagcctgaaggacgatgttggggcccttcgctcgaagctgctgcctggcgtcaagcaggcgctggctaccatggatgctacgcagctctttgacacgttcgggactcactatgtgagcgaggtgcttgtgggtgggcatgcagactacgttgccaccaccaagaccagcgcgttcagctcatccaccagcatcagcgtagcggcagaagcatcattccagtccatcgcgggtggggaggtgtctccggagtccaaggtgcttgcggagacgctgagagagaacagcagcacacgcctgtacgctcttggcgggagtgccctccccaacatcacagatccagccacgtacaacgcctggctgcagtccattgacaccatccctgtcttctgcggattcactcaaaacagcctcaagcccatctcggagcttgctgactccgctcaacgccgggacgctctggccaaagcctcccaaagctatatcccatcatacgtgactcgtcctgcagtggttggcttggaggtcataatatcggacagcaactcggagagccctccctatggctacaccagaatagactacgacctcaaccgcaacgcaggaggcaaatacgtgttcctctgctacaagcagaagaacatttcagtgggaggggatgccgatgccatcaccgacgtccttgtcgtctacggaaatgaccgaaatccatctgtgccgtctggctacaccaagatcgacaaggacctcaactccggggcaggcggtaagtatatctacttctgctactccaaggacaagcggaagcaagaggagggactgcccattcgtgggcttcgtgttgttgggcctcacccaacctcagtggcaccttacggattctctaagatcgacatagatctgaatatgggtgcaggaggagattttatatacctttgcaaatcacgccatttggag

SEQ ID NO: 110 - protein, 478 aa, Ophioglossum pendulum
MEPNKGGAPAMKNVAKPSTKRLIPSSIAASSQTSANALTEPLPGSDAIGQSYDAFGFFANPRSIMKELFEFSPQEEIVVEGNTWLLSSDFVYTAIRDTETSTVSRRTKDDYSKELAVKVKLSGSYGYFSASVESDFSQSISDATDTTYTSVRTHVNKWRLSLKDDVGALRSKLLPGVKQALATMDATQLFDTFGTHYVSEVLVGGHADYVATTKTSAFSSSTSISVAAEASFQSIAGGEVSPESKVLAETLRENSSTRLYALGGSALPNITDPATYNAWLQSIDTIPVFCGFTQNSLKPISELADSAQRRDALAKASQSYIPSYVTRPAVVGLEVIISDSNSESPPYGYTRIDYDLNRNAGGKYVFLCYKQKNISVGGDADAITDVLVVYGNDRNPSVPSGYTKIDKDLNSGAGGKYIYFCYSKDKRKQEEGLPIRGLRVVGPHPTSVAPYGFSKIDIDLNMGAGGDFIYLCKSRHLE

SEQ ID NO: 111 - DNA, 1434 bp, Ophioglossum pendulum
atggaacccaacaaaggtggtgctccagccatgaaaaatgtagccaaaccttccacaaagagactcataccgtcatccattgctgcatcatcgcaaacatctgcaaatgcattaaccgagccattgcctggctctgatgccatcggccagagctacgatgcgttcgggttcttcgccaatcccagaagcatcatgaaggagttgtttgagttcagtcctcaagaggagatagtcgtggaaggaaatacctggcttctctcttcggacttcgtttacaccgcaattagagacactgagacctccacggtctcacgtcgcaccaaggacgactactccaaggaattggctgtgaaggtgaagctgtctggaagctatggctttttttctgcctccgttgagtctgatttctctcagagcatttccgatgtgacggacaccacatacacttcagttcgcacccacgtcaacaagtggaggctgagcctgaaggacgatgttggggcccttcgctcgaagctgctgcctggcttcaagcaggcgctggctaccatggatgctacgcagctctttgacacgttcgggactcactatgtgagcgaggtgcttgtgggtgggcgtgcagactacgttgccaccaccaagaccagcgcgttcagctcatccaccagcatcagcgtagcggcagaagcatcattccagtccatcgcgggtggggaggtgtctccggagtccaaggtgcttgcggagacgctgagagagaacagcagcacacgcctgtacgctcttggcgggagtgccctccccaacatcacagatccagccacgtacaacgcctggctgcagtccattgacaccatccctgtcttctgcggattcactcaaaacagcctcaagcccatctcggagcttgctgactccgctcaacgccgggacgctctggccaaagcctcccaaagctatatcccatcatacgtgactcgtcctgcagtggttggcttggaggtcataatatcggacagcaactcggagagccctccctatggctacaccagaatagactacgacctcaaccgcaacgcaggaggcaaatacgtgttcctctgctacaagcagaagaacatttcagtgggaggggatgccgatgccatcaccgacgtccttgtcgtctacggaaatgaccgaaatccatctgtgccgtctggctacaccaagatcgacaaggacctcaactccggggcaggcggtaagtatatctacttctgctactccaaggacaagcggaagcaagaggagggactgcctattcgtgggcttcgtgttgttgggcctcacccaacctcagtggcaccttacggattctctaagatcgacatagatctgaatatgggtgcaggaggagattttatatacctttgcaaatcacgccatttggag

SEQ ID NO: 112 - protein, 478 aa, Ophioglossum pendulum
MEPNKGGAPAMKNVAKPSTKRLIPSSIAASSQTSANALTEPLPGSDAIGQSYDAFGFFANPRSIMKELFEFSPQEEIVVEGNTWLLSSDFVYTAIRDTETSTVSRRTKDDYSKELAVKVKLSGSYGFFSASVESDFSQSISDVTDTTYTSVRTHVNKWRLSLKDDVGALRSKLLPGFKQALATMDATQLFDTFGTHYVSEVLVGGRADYVATTKTSAFSSSTSISVAAEASFQSIAGGEVSPESKVLAETLRENSSTRLYALGGSALPNITDPATYNAWLQSIDTIPVFCGFTQNSLKPISELADSAQRRDALAKASQSYIPSYVTRPAVVGLEVIISDSNSESPPYGYTRIDYDLNRNAGGKYVFLCYKQKNISVGGDADAITDVLVVYGNDRNPSVPSGYTKIDKDLNSGAGGKYIYFCYSKDKRKQEEGLPIRGLRVVGPHPTSVAPYGFSKIDIDLNMGAGGDFIYLCKSRHLE

SEQ ID NO: 113 - DNA, 1434 bp, Ophioglossum pendulum
atggaacccaacaaaggtggtgctccagccatgaaaaatgtagccaaaccttccacaaagagactcataccgtcatccattgctgcatcatcgcaaccatctgcaaatgcattaaccgagccattgcctggctctgatgccatcggccagagctacgatgcattcgggttcttcgccaatcccagaagcatcatgaaggagttgttcgagttcagtcctcaagaggagatagtcgtggaaggaaatacctggcttctctcttcggacttcgtttacaccgcaattagagacactgagacctccacggtctcacgtcgcaccaaggacgactactccaaggaattggctgtgaaggtgaagctgtctggaagctatggctatttttctgcctccgttgagtctgatttctctcagagcatttccgatgcgacggacaccacatacacttcagttcgcacccacgtcaacaagtggaggctgagcctgaaggacgatgttggggcccttcgctcgaagctgctgcctggcttcaagcaggcgctggctaccatggatgctacgcagctctttgacacgttcgggactcactatgtgagcgaggtgcttgtgggtgggcgtgcagactacgttgccaccaccaagaccagcgcgttcagctcatccaccagcatcagcgtagcggcagaagcatcattccagtccatcgcgggtggggaggtgtctccggagtccaaggtgcttgcggagacgctgagagagaacagcagcacacgcctgtacgctcttggagggagtgccctccccaacatcacagatccagccacgtacaacgcctggctggagtccattgacaccatccctgtcttctgcggattcactcaaaacagcctcaagcccatctcggagcttgctgactccgctcaacgccgggacgctctggccaaagcctcccaaagctatatcccatcatacgtgactcgtcctgcagtggttggcttggaggtcataatatcggacagcaactcggagagccctccctatggctacaccagaatagactacgacctcaaccgcaacgcaggaggcaaatacgtgttcctctgctacaagcagaagaacatttcagtgggaggggatgccgatgccatcaccgacgtccttgtcgtctacggaaatgaccgaaatccatctgtgccgtctggctacaccaagatcgacaaggacctcaactccggggcaggcggtaagtatatctacttctgctactccaaggacaagcggaagcaagaggagggactgcccattcgtgggcttcgtgttgttgggcctcacccaacctcagtggcaccttacggattctctaagatcgacatagatctgaatatgggtgcaggaggagattttatatacctttgcaaatcacgccatttggag

SEQ ID NO: 114 - protein, 478 aa, Ophioglossum pendulum
MEPNKGGAPAMKNVAKPSTKRLIPSSIAASSQPSANALTEPLPGSDAIGQSYDAFGFFANPRSIMKELFEFSPQEEIVVEGNTWLLSSDFVYTAIRDTETSTVSRRTKDDYSKELAVKVKLSGSYGYFSASVESDFSQSISDATDTTYTSVRTHVNKWRLSLKDDVGALRSKLLPGFKQALATMDATQLFDTFGTHYVSEVLVGGRADYVATTKTSAFSSSTSISVAAEASFQSIAGGEVSPESKVLAETLRENSSTRLYALGGSALPNITDPATYNAWLESIDTIPVFCGFTQNSLKPISELADSAQRRDALAKASQSYIPSYVTRPAVVGLEVIISDSNSESPPYGYTRIDYDLNRNAGGKYVFLCYKQKNISVGGDADAITDVLVVYGNDRNPSVPSGYTKIDKDLNSGAGGKYIYFCYSKDKRKQEEGLPIRGLRVVGPHPTSVAPYGFSKIDIDLNMGAGGDFIYLCKSRHLE

SEQ ID NO: 115 - DNA, 1434 bp, Ophioglossum pendulum
atggaacccaacaaaggtggtgctccagccatgaaaaatgtagccaaaccttccacaaagagactcataccgtcatccattgctgcatcatcgcaaacatctgcaaatgcattaaccgagccattgcctggctctgatgccatcggccagagctacgatgcattcgggttcttcgccaatcccagaagcatcatgaaggagttgttcgagttcagtcctcaagaggagatagtcgtggaaggaaatacctggcttctctcttcggacttcgtttacaccgcaattagagacactgagacctccacggtctcacgtcgcaccaaggacgactactccaaggaattggctgtgaaggtgaagctgtctggaagctatggctatttttctgcctccgttgagtctgatttctctcagagcatttccgatgcgacggacaccacatacacttcagttcgcacccacgtcaacaagtggaggctgagcctgaaggacgatgttggggcccttcgctcgaagctgctgcctggcttcaagcaggcgctggctaccatggatgctacgcagctctttgacacgttcgggactcactatgtgagcgaggtgcttgtgggtgggcgtgcagactacgttgccaccaccaagaccagcgcgttcagctcatccaccagcatcagcgtagcggcagaagcatcattccagtccatcgcgggtggggaggtgtctccggagtccaaggtgcttgcggagacgctgagagagaacagcagcacacgcctgtacgctcttggagggagtgccctccccaacatcacagatccagccacgtacaacgcctggctggagtccattgacaccatccctgtcttctgcggattcactcaaaacagcctcaagcccatctcggagcttgctgactccgctcaacgccgggacgctctggccaaagcctcccaaagctatatcccatcatacgtgactcgtcctgcagtggttggcttggaggtcataatatcggacagcaactcggagagccctccctatggctacaccagaatagactacgacctcaaccgcaacgcaggaggcaaatacgtgttcctctgctacaagcagaagaacatttcagtgggaggggatgccgatgccatcaccgacgtccttgtcgtctacggaaatgaccgaaatccatctgtgccgtctggctacaccaagatcgacaaggacctcaactccggggcaggcggtaagtatatctacttctgctactccaaggacaagcggaagcaagaggagggactgcccattcgtgggcttcgtgttgttgggcctcacccaacctcagtggcaccttacggattctctaagatcgacatagatctgaatatgggtgcaggaggagattttatatacctttgcaaatcacgccatttggag

SEQ ID NO: 116 - protein, 478 aa, Ophioglossum pendulum
MEPNKGGAPAMKNVAKPSTKRLIPSSIAASSQTSANALTEPLPGSDAIGQSYDAFGFFANPRSIMKELFEFSPQEEIVVEGNTWLLSSDFVYTAIRDTETSTVSRRTKDDYSKELAVKVKLSGSYGYFSASVESDFSQSISDATDTTYTSVRTHVNKWRLSLKDDVGALRSKLLPGFKQALATMDATQLFDTFGTHYVSEVLVGGRADYVATTKTSAFSSSTSISVAAEASFQSIAGGEVSPESKVLAETLRENSSTRLYALGGSALPNITDPATYNAWLESIDTIPVFCGFTQNSLKPISELADSAQRRDALAKASQSYIPSYVTRPAVVGLEVIISDSNSESPPYGYTRIDYDLNRNAGGKYVFLCYKQKNISVGGDADAITDVLVVYGNDRNPSVPSGYTKIDKDLNSGAGGKYIYFCYSKDKRKQEEGLPIRGLRVVGPHPTSVAPYGFSKIDIDLNMGAGGDFIYLCKSRHLE

SEQ ID NO: 117 - DNA, 1434 bp, Ophioglossum pendulum
atggaacccaacaaaggtggtgctccagccatgaaaaatgtagccaaaccttccacaaagagactcataccgtcatccattgctgcatcatcgcaaacatctgcaaatgcattaaccgagccattgcctggctctgatgccatcggccagagctacgatgcgttcgggttcttcgccaatcccagaagcatcatgaaggagttgtttgagttcagtcctcaagaggagatagtcgtggaaggaaatacctggcttctctcttcggacttcgtttacaccgcaattagagacactgagacctccacggtctcacgtcgcaccaaggacgactactccaaggaattggctgtgaaggtgaagctgtctggaagctatggctttttttctgcctccgttgagtctgatttctctcagagcatttccgatgcgacggacaccacatacacttcagttcgcacccacgtcaacaagtggaggctgagcctgaaggacgatgttggggcccttcgctcgaagctgctgcctggcgtcaagcaggcgctggctaccatggatgctacgcagctctttgacacgttcgggactcactatgtgagcgaggtgcttgtgggtgggcgtgcagactacgttgccaccaccaagaccagcgcgttcagctcatccaccagcatcagcgtagcggcagaagcatcattccagtccatcgcgggtggggaggtgtctccggagtccaaggtgcttgcggagacgctgagagagaacagcagcacacgcctgtacgctcttggcgggagtgccctccccaacatcacagatccagccacgtacaacgcctggctgcagtccattgacaccatccctgtcttctgcggattcactcaaaacagcctcaagcccatctcggagcttgctgactccgctcaacgccgggacgctctggccaaagcctcccaaagctatatcccatcatacgcgactcgtcctgcagtggttggcttggaggtcataatatcggacagcaactcggagagccctccctatggctacaccagaatagactacgacctcaaccgcaacgcaggaggcaaatacgtgttcctctgctacaagcagaagaacatttcagtgggaggggatgccgatgccatcaccgacgtccttgtcgtctacggaaatgaccgaaatccatctgtgccgtctggctacaccaagatcgacaaggacctcaactccggggcaggcggtaagtatatctacttctgctactccaaggacaagcggaagcaagaggagggactgcctattcgtgggcttcgtgttgttgggcctcacccaacctcagtggcaccttacggattctctaagatcgacatagatctgaatatgggtgcaggaggagattttatatacctttgcaaatcacgccatttggag

SEQ ID NO: 118 - protein, 478 aa, Ophioglossum pendulum
MEPNKGGAPAMKNVAKPSTKRLIPSSIAASSQTSANALTEPLPGSDAIGQSYDAFGFFANPRSIMKELFEFSPQEEIVVEGNTWLLSSDFVYTAIRDTETSTVSRRTKDDYSKELAVKVKLSGSYGFFSASVESDFSQSISDATDTTYTSVRTHVNKWRLSLKDDVGALRSKLLPGVKQALATMDATQLFDTFGTHYVSEVLVGGRADYVATTKTSAFSSSTSISVAAEASFQSIAGGEVSPESKVLAETLRENSSTRLYALGGSALPNITDPATYNAWLQSIDTIPVFCGFTQNSLKPISELADSAQRRDALAKASQSYIPSYATRPAVVGLEVIISDSNSESPPYGYTRIDYDLNRNAGGKYVFLCYKQKNISVGGDADAITDVLVVYGNDRNPSVPSGYTKIDKDLNSGAGGKYIYFCYSKDKRKQEEGLPIRGLRVVGPHPTSVAPYGFSKIDIDLNMGAGGDFIYLCKSRHLE

SEQ ID NO: 119 - DNA, 1434 bp, Ophioglossum pendulum
atggaacccaacaaaggtggtgctccagccatgaaaaatgtagccaaaccttccacaaagagactcataccgtcatccattgctgcatcatcgcaaacatctgcaaatgcattaaccgagccattgcctggctctgatgccatcggccagagctacgatgcattcgggttcttcgccaatcccagaagcatcatgaaggagttgttcgagttcagtcctcaagaggagatagtcgtggaaggaaatacctggcttctctcttcggacttcgtttacaccgcaattagagacactgagacctccacggtctcacgtcgcaccaaggacgactactccaaggaattggctgtgaaggtgaagctgtctggaagctatggctatttttctgcctccgttgagtctgatttctctcagagcatttccgatgcgacggacaccacatacacttcagttcgcacccacgtcaacaagtggaggctgagcctgaaggacgatgttggggcccttcgctcgaagctgctgcctggcgtcaagcaggcgctggctaccatggatgctacgcagctctttgacacgttcgggactcactatgtgagcgaggtgcttgtgggtgggcgtgcagactacgttgccaccaccaagaccagcgcgttcagctcatccaccagcatcagcgtagcggcagaagcatcattccagtccatcgcgggtggggaggtgtctccggagtccaaggtgcttgcggagacgctgagagagaacagcagcacacgcctgtacgctcttggcgggagtgccctccccaacatcacagatccagccacgtacaacgcctggctgcagtccattgacaccatccctgtcttctgcggattcactcaaaacagcctcaagcccatctcggagcttgctgactccgctcaacgccgggacgctctggccaaagcctcccaaagctatatcccatcatacgtgactcgtcctgcagtggttggcttggaggtcataatatcggacagcaactcggagagccctccctatggctacaccagaatagactacgacctcaaccgcaacgcaggaggcaaatacgtgttcctctgctacaagcagaagaacatttcagtgggaggggatgccgatgccatcaccgacgtccttgtcgtctacggaaatgaccgaaatccatctgtgccgtctggctacaccaagatcgacaaggacctcaactccggggcaggcggtaagtatatctacttctgctactccaaggacaagcggaagcaagaggagggactgcctattcgtgggcttcgtgttgttgggcctcacccaacctcagtggcaccttacggattctctaagatcgacatagatctgaatatgggtgcaggaggagattttatatacctttgcaaatcacgccatttggag

SEQ ID NO: 120 - protein, 478 aa, Ophioglossum pendulum
MEPNKGGAPAMKNVAKPSTKRLIPSSIAASSQTSANALTEPLPGSDAIGQSYDAFGFFANPRSIMKELFEFSPQEEIVVEGNTWLLSSDFVYTAIRDTETSTVSRRTKDDYSKELAVKVKLSGSYGYFSASVESDFSQSISDATDTTYTSVRTHVNKWRLSLKDDVGALRSKLLPGVKQALATMDATQLFDTFGTHYVSEVLVGGRADYVATTKTSAFSSSTSISVAAEASFQSIAGGEVSPESKVLAETLRENSSTRLYALGGSALPNITDPATYNAWLQSIDTIPVFCGFTQNSLKPISELADSAQRRDALAKASQSYIPSYVTRPAVVGLEVIISDSNSESPPYGYTRIDYDLNRNAGGKYVFLCYKQKNISVGGDADAITDVLVVYGNDRNPSVPSGYTKIDKDLNSGAGGKYIYFCYSKDKRKQEEGLPIRGLRVVGPHPTSVAPYGFSKIDIDLNMGAGGDFIYLCKSRHLE

SEQ ID NO: 121 - DNA, 1434 bp, Ophioglossum pendulum
atggaacccaagacaggtggtgctccagccatgaaaaatgtagccaaaccttccacaaagacactcataccgtcatccattgctgcatcatcgcaaacagctgcaaatgcattaaccgagccattgcctggctctgatgccatcggccagagctacgatgcattcgggttcttcgccaatcccagaagcatcatgaaggagttgttcgagttcagtcctcaagaggagatagtcgtggaaggaaatacctggcttctctcttcggacttcgtttacaccgcaattagagacactgagacctccacggtctcacgtcgcaccaaggacgactactccaaggaattggctgtgaaggtgaagctgtctggaagctatggctttttttctgcctccgttgagtctgatttctctcagagcatttccgatgtgacggacaccacatacacttcagttcgcacccacgtcaacaagtggaggctgagcctgaaggacgatgttggggcccttcgctcgaagctgctgcctggcttcaagcaggcgctggctaccatggatgctacgcagctctttgacacgttcgggactcactatgtgagcgaggtgcttgtgggtgggcgtgcagactacgttgccaccaccaagaccagcgcgttcagctcatccaccagcatcagcgtagcggcagaagcatcattccagtccatcgcgggtggggaggtgtctccggagtccaaggtgcttgcggagatgctgagagagaacagcagcacacgcctgtacgctcttggcgggagtgccctccccaacatcacagatccagccacgtacaacgcctggctggagtccattgacaccatccctgtcttctgcggattcactcaaaacagcctcaagcccatctcggagcttgctgactccgctcaacgccgggacgctctggccaaagcctcccaaagctatatcccatcatacgtgactcgtcctgcagtggttggcttggaggtcataatatcggacagcaactcggagagccctccctatggctacaccagaatagactacgacctcaaccgcaacgcaggaggcaaatacgtgttcctctgctacaagcagaagaacatttcagtgggaggggatgccgatgccatcaccgacgtccttgtcgtctacggaaatgaccgaaatccatctgtgccgtctggctacaccaagatcgacaaggacctcaactccggggcaggcggtaagtatatctacttctgctactccaaggacaagcggaagcaagaggagggactgcccattcgtgggcttcgtgttgttgggcctcacccaacctcagtggcaccttacggattctctaagatcgacatagatctgaatatgggtgcaggaggagattttatatacctttgcaaatcacgccatttggag

SEQ ID NO: 122 - protein, 478 aa, Ophioglossum pendulum
MEPKTGGAPAMKNVAKPSTKTLIPSSIAASSQTAANALTEPLPGSDAIGQSYDAFGFFANPRSIMKELFEFSPQEEIVVEGNTWLLSSDFVYTAIRDTETSTVSRRTKDDYSKELAVKVKLSGSYGFFSASVESDFSQSISDVTDTTYTSVRTHVNKWRLSLKDDVGALRSKLLPGFKQALATMDATQLFDTFGTHYVSEVLVGGRADYVATTKTSAFSSSTSISVAAEASFQSIAGGEVSPESKVLAEMLRENSSTRLYALGGSALPNITDPATYNAWLESIDTIPVFCGFTQNSLKPISELADSAQRRDALAKASQSYIPSYVTRPAVVGLEVIISDSNSESPPYGYTRIDYDLNRNAGGKYVFLCYKQKNISVGGDADAITDVLVVYGNDRNPSVPSGYTKIDKDLNSGAGGKYIYFCYSKDKRKQEEGLPIRGLRVVGPHPTSVAPYGFSKIDIDLNMGAGGDFIYLCKSRHLE

SEQ ID NO: 123 - DNA, 1433 bp, Ophioglossum pendulum
atggaacccaacaaaggtggtgctccagccatgaaaaatgtagccaaaccttccacaaagagactcataccgtcatccattgctgcatcatcgcaaacatctgcaaatgcattaaccgagccattgcctggctctgatgccatcggccagagctacgatgcattcgggttcttcgccaatcccagaagcatcatgaaggagttgtttgagttcagtcctcaagaggagatagtcgtggaaggaaatacctggcttctctcttcggacttcgtttacaccgcaattagagacactgagacctccacggtctcacgtcgcaccaaggacgactactccaaggaattggctgtgaaggtgaagctgtctggaagctatggctttttttctgcctccgttgagtctgatttctctcagagcatttccgatgtgacggacaccacatacacttcagttcgcacccacgtcaacaagtggaggctgagcctgaaggacgatgttggggcccttcgctcgaagctgctgcctggcttcaagcaggcgctggctaccatggatgctacgcagctctttgacacgttcgggactcactatgtgagcgaggtgcttgtgggtgggcgtgcagactacgttgccaccaccaagaccagcgcgttcagctcatccaccagcatcagcgtagcggcagaagcatcattccagtccatcgcgggtggggaggtgtctccggagtccaaggagcttgcggagacgctgagagagaacagcagcacacgcctgtacgctcttggcgggagtgccctccccaacatcacagatccagccacgtacaacgcctggctggagtccattgacaccatccctgtcttctgcggattcactcaaaacagcctcaagcccatctcggagcttgctgactccgctcaacgccgggacgctctggccaaagcctcccaaagctatatcccatcatacgtgactcgtcctgcagtggttggcttggaggtcataatatcggacagcaactcggagagccctccctatggctacaccagaatagactacgacctcaaccgcaacgcaggaggcaaatacgtgttcctctgctacaagcagaagaacatttcagtgggaggggatgccgatgccatcaccgacgtccttgtcgtctacggaaatgaccgaaatccatctgtgccgtctggctacaccaagatcgacaaggacctcaactccggggcaggcggtaagtatatctacttctgctactccaaggacaagcggaagcaagaggagggactgcccattcgtgggcttcgtgttgttgggcctcacccaacctcagtggcaccttacggattctctaagatcgacatagatctgaatatgggtgcaggaggagattttatatacctttgcaaatcacgccatttgag

SEQ ID NO: 124 - protein, 478 aa, Ophioglossum pendulum
MEPNKGGAPAMKNVAKPSTKRLIPSSIAASSQTSANALTEPLPGSDAIGQSYDAFGFFANPRSIMKELFEFSPQEEIVVEGNTWLLSSDFVYTAIRDTETSTVSRRTKDDYSKELAVKVKLSGSYGFFSASVESDFSQSISDVTDTTYTSVRTHVNKWRLSLKDDVGALRSKLLPGFKQALATMDATQLFDTFGTHYVSEVLVGGRADYVATTKTSAFSSSTSISVAAEASFQSIAGGEVSPESKELAETLRENSSTRLYALGGSALPNITDPATYNAWLESIDTIPVFCGFTQNSLKPISELADSAQRRDALAKASQSYIPSYVTRPAVVGLEVIISDSNSESPPYGYTRIDYDLNRNAGGKYVFLCYKQKNISVGGDADAITDVLVVYGNDRNPSVPSGYTKIDKDLNSGAGGKYIYFCYSKDKRKQEEGLPIRGLRVVGPHPTSVAPYGFSKIDIDLNMGAGGDFIYLCKSRHLS

SEQ ID NO: 125 - DNA, 1434 bp, Ophioglossum pendulum
atggaacccaacaaaggtggtgctccagccatgaaaaatgtagccaaaccttccacaaagagactcataccgtcatccattgctgcatcatcgcaaacatctgcaaatgcattaaccgagccattgcctggctctgatgccatcggccagagctacgatgcgttcgggttcttcgccaatcccagaagcatcatgaaggagttgtttgagttcagtcctcaagaggagatagtcgtggaaggaaatacctggcttctctcttcggacttcgtttacaccgcaattagagacactgagacctccacggtctcacgtcgcaccaaggacgactactccaaggaattggctgtgaaggtgaagctgtctggaagctatggctttttttctgcctccgttgagtctgatttctctcagagcatttccgatgtgacggacaccacatacacttcagttcgcacccacgtcaacaagtggaggctgagcctgaaggacgatgttggggcccttcgctcgaagctgctgcctggcttcaagcaggcgctggctaccatggatgctacgcagctctttgacacgttcgggactcactatgtgagcgaggtgcttgtgggtgggcgtgcagactacgttgccaccaccaagaccagcgcgttcagctcatcccccagcatcagcgtagcggcagaagcatcattccagtccatcgcgggtggggaggtgtctccggagtccaaggtgcttgcggagacgctgagagagaacagcagcacacgcctgtacgctcttggcgggagtgccctccccaacatcacagatccagccacgtacaacgcctggctgcagtccattgacaccatccctgtcttctgcggattcactcaaaacagcctcaagcccatctcggagcttgctgactccgctcaacgccgggacgctctggccaaagcctcccaaagctatatcccatcatacgtgactcgtcctgcagtggttggcttggaggtcataatatcggacagcaactcggagagccctccctatggctacaccagaatagactacgacctcaaccgcaacgcaggaggcaaatacgtgttcctctgctacaagcagaagaacatttcagtgggaggggatgccgatgccatcaccgacgtccttgtcgtctacggaaatgaccgaaatccatctgtgccgtctggctacaccaagatcgacaaggacctcaactccggggcaggcggtaagtatatctacttctgctactccaaggacaagcggaagcaagaggagggactgcctattcgtgggcttcgtgttgttgggcctcacccaacctcagtggcaccttacggattctctaagatcgacatagatctgaatatgggtgcaggaggagattttatatacctttgcaaatcacgccatttggag

SEQ ID NO: 126 - protein, 478 aa, Ophioglossum pendulum
MEPNKGGAPAMKNVAKPSTKRLIPSSIAASSQTSANALTEPLPGSDAIGQSYDAFGFFANPRSIMKELFEFSPQEEIVVEGNTWLLSSDFVYTAIRDTETSTVSRRTKDDYSKELAVKVKLSGSYGFFSASVESDFSQSISDVTDTTYTSVRTHVNKWRLSLKDDVGALRSKLLPGFKQALATMDATQLFDTFGTHYVSEVLVGGRADYVATTKTSAFSSSPSISVAAEASFQSIAGGEVSPESKVLAETLRENSSTRLYALGGSALPNITDPATYNAWLQSIDTIPVFCGFTQNSLKPISELADSAQRRDALAKASQSYIPSYVTRPAVVGLEVIISDSNSESPPYGYTRIDYDLNRNAGGKYVFLCYKQKNISVGGDADAITDVLVVYGNDRNPSVPSGYTKIDKDLNSGAGGKYIYFCYSKDKRKQEEGLPIRGLRVVGPHPTSVAPYGFSKIDIDLNMGAGGDFIYLCKSRHLE

SEQ ID NO: 127 - DNA, 1434 bp, Ophioglossum pendulum
atggaacccaacaaaggtggtgctccagccatgaaaaatgtagccaaaccttccacaaagagactcataccgtcatccattgctgcatcatcgcaagcatctgcaaatgcattaaccgagccattgcctggctctgatgccatcggccagagctacgatgcattcgggttcttcgccaatcccagaagcatcatgaaggagttgtttgagttcagtcctcaagaggagatagtcgtggaaggaaatacctggcttctctcttcggacttcgtttacaccgcaattagagacactgagacctccacggtctcacgtcgcaccaaggacgactactccaaggaattggctgtgaaggtgaagctgtctggaagctatggctatttttctgcctccgttgagtctgatttctctcagagcatttccgatgcgacggacaccacatacacttcagttcgcacccacgtcaacaagtggaggctgagcctgaaggacgatgttggggcccttcgctcgaagctgctgcctggcttcaagcaggcgctggctaccatggatgctacgcagctctttgacacgttcgggactcactatgtgagcgaggtgcttgtgggtgggcgtgcagactacgttgccaccaccaagaccagcgcgttcagctcatccaccagcatcagcgtagcggcagaagcatcattccagtccatcgcgggtggggaggtgtctcctgcgtccaaggtgcttgcggagatgctgagagagaacagcagcacacgcctgtacgctcttggcgtgagtgccctccccaacatcacagatccagccacgtacaacgcctggctggagtccattgacaccatccctgtcttctgcggattcactcaaaacagcctcaagcccatctcggagcttgctgactccgctcaacgccgggtcgctctggccaaagcctcccaaagctatatcccatcatacgtgactcgtcctgcagtggttggcttggaggtcataatatcggacagcaactcggagagccctccctatggctacaccagaatagactacgacctcaaccgcaacgcaggaggtaaatacgtgttcctctgctacaagcagaagaacatttcagtgggaggggatgccgatgccatcaccgacgtccttgtcgtctacggaaatgaccgaaatccatctgttccgtctggctacaccaagatcgacaaggacctcaactccggggcaggcggtaagtatatctacttctgttactccaaggacaagcggaagcaagaggagggaccgcccattcgtgggcttcgtgttgttgggcctcacccaacctcagtggcaccttacggattctctaagatcgacatagatctgaatatgggtgcaggaggagattttatatacctttgcaaatcacgccatttggag

SEQ ID NO: 128 - protein, 478 aa, Ophioglossum pendulum
MEPNKGGAPAMKNVAKPSTKRLIPSSIAASSQASANALTEPLPGSDAIGQSYDAFGFFANPRSIMKELFEFSPQEEIVVEGNTWLLSSDFVYTAIRDTETSTVSRRTKDDYSKELAVKVKLSGSYGYFSASVESDFSQSISDATDTTYTSVRTHVNKWRLSLKDDVGALRSKLLPGFKQALATMDATQLFDTFGTHYVSEVLVGGRADYVATTKTSAFSSSTSISVAAEASFQSIAGGEVSPASKVLAEMLRENSSTRLYALGVSALPNITDPATYNAWLESIDTIPVFCGFTQNSLKPISELADSAQRRVALAKASQSYIPSYVTRPAVVGLEVIISDSNSESPPYGYTRIDYDLNRNAGGKYVFLCYKQKNISVGGDADAITDVLVVYGNDRNPSVPSGYTKIDKDLNSGAGGKYIYFCYSKDKRKQEEGPPIRGLRVVGPHPTSVAPYGFSKIDIDLNMGAGGDFIYLCKSRHLE

SEQ ID NO: 129 - DNA, 1434 bp, Ophioglossum pendulum
atggaacccaacaaaggtggtgctccagccatgaaaaatgtagccaaaccttccacaaagagactcataccgtcatccattgctgcatcatcgcaaacatctgcaaatgcattaaccgagccattgcctggctctgattccatcggccagagctacgatgcgttcgggttcttcgccaatcccagaagcatcatgaaggagttgttcgagttcagtcctcaagaggagatagtcgtggaaggaaatacctggcttctctcttcggacttcgtttacaccgcaattagagacactgagacctccacggtctcacgtcgcaccaaggacgactactccaaggaattggctgtgaaggtgaagctgtctggaagctatggctttttttctgcctccgttgagtctgatttctctcagagcatttccgatgtgacggacaccacatacacttcagttcgcacccacgtcaacaagtggaggctgagcctgaaggacgatgttggggcccttcgctcgaagctgctgcctggcttcaagcaggcgctggctaccatggatgctacgcagctctttgacacgttcgggactcactatgtgagcgaggtgcttgtgggtgggcgtgcagactacgttgccaccaccaagaccagcgcgttcagctcatccaccagcatcagcgtagcggcagaagcatcattccagtccatcgcgggtggggaggtgtctccggagtccaaggtgcttgcggagacgctgagagagaacagcagcacacgcctgtacgctcttggcgggagtgccctccccaacatcacagatccagccacgtacaacgcctggctgcagtccattgacaccatccctgtcttctgcggattcactcaaaacagcctcaagcccatctcggagcttgctgactccgctcaacgccgggacgctctggccaaagcctcccaaagctatatcccatcatacgtgactcgtcctgcagtggttggcttggaggtcataatatcggacagcaactcggagagccctccctatggctacaccagaatagactacgacctcaaccgcaacgcaggaggcaaatacgtgttcctctgctacaagcagaagaacatttcagtgggaggggatgccgatgccatcaccgacgtccttgtcgtctacggaaatgaccgaaatccatctgtgccgtctggctacaccaagatcgacaaggacctcaactccggggcaggcggtaagtatatctacttctgctactccaaggacaagcggaagcaagaggagggactgcctattcgtgggcttcgtgttgttgggcctcactcaacctcagtggcaccttacggattctctaagatcgacatagatctgaatatgggtgcaggaggagattttatatacctttgcaaatcacgccatttggag

SEQ ID NO: 130 - protein, 478 aa, Ophioglossum pendulum
MEPNKGGAPAMKNVAKPSTKRLIPSSIAASSQTSANALTEPLPGSDSIGQSYDAFGFFANPRSIMKELFEFSPQEEIVVEGNTWLLSSDFVYTAIRDTETSTVSRRTKDDYSKELAVKVKLSGSYGFFSASVESDFSQSISDVTDTTYTSVRTHVNKWRLSLKDDVGALRSKLLPGFKQALATMDATQLFDTFGTHYVSEVLVGGRADYVATTKTSAFSSSTSISVAAEASFQSIAGGEVSPESKVLAETLRENSSTRLYALGGSALPNITDPATYNAWLQSIDTIPVFCGFTQNSLKPISELADSAQRRDALAKASQSYIPSYVTRPAVVGLEVIISDSNSESPPYGYTRIDYDLNRNAGGKYVFLCYKQKNISVGGDADAITDVLVVYGNDRNPSVPSGYTKIDKDLNSGAGGKYIYFCYSKDKRKQEEGLPIRGLRVVGPHSTSVAPYGFSKIDIDLNMGAGGDFIYLCKSRHLE

SEQ ID NO: 131 - DNA, 1434 bp, Ophioglossum pendulum
atggaacccaacaaaggtggtgctccagccatgaaaaatgtagccaaaccttccacaaagagactcataccgtcatccattgctgcatcatcgcaaacatctgcaaatgcattaaccgagccattgcctggctctgattccatcggccagagctacgatgcgttcgggttcttcgccaatcccagaagcatcatgaaggagttgttcgagttcagtcctcaagaggagatagtcgtggaaggaaatacctggcttctctcttcggacttcgtttacaccgcaattagagacactgagacctccacggtctcacgtcgcaccaaggacgactactccaaggaattggctgtgaaggtgaagctgtctggaagctatggctttttttctgcctccgttgagtctgatttctctcagagcatttccgatgtgacggacaccacatacacttcagttcgcacccacgtcaacaagtggaggctgagcctgaaggacgatgttggggcccttcgctcgaagctgctgcctggcttcaagcaggcgctggctaccatggatgctacgcagctctttgacacgttcgggactcactatgtgagcgaggtgcttgtgggtgggcgtgcagactacgttgccaccaccaagaccagcgcgttcagctcatccaccagcatcagcgtagcggcagaagcatcattccagtccatcgcgggtggggaggtgtctccggagtccaaggtgcttgcggagacgctgagagagaacagcagcacacgcctgtacgctcttggcgggagtgccctccccaacatcacagatccagccacgtacaacgcctggctgcagtccattgacaccatccctgtcttctgcggattcactcaaaacagcctcaagcccatctcggagcttgctgactccgctcaacgccgggacgctctggccaaagcctcccaaagctatatcccatcatacgcgactcgtcctgcagtggttggcttggaggtcataatatcggacagcaactcggagagccctccctatggctacaccagaatagactacgacctcaaccgcaacgcaggaggcaaatacgtgttcctctgctacaagcagaagaacatttcagtgggaggggatgccgatgccatcaccgacgtccttgtcgtctacggaaatgaccgaaatccatctgtgccgtctggctacaccaagatcgacaaggacctcaactccggggcaggcggtaagtatatctacttctgctactccaaggacaagcggaagcaagaggagggactgcctattcgtgggcttcgtgttgttgggcctcacccaacctcagtggcaccttacggattctctaagatcgacatagatctgaatatgggtgcaggaggagattttatatacctttgcaaatcacgccatttggag

SEQ ID NO: 132 - protein, 478 aa, Ophioglossum pendulum
MEPNKGGAPAMKNVAKPSTKRLIPSSIAASSQTSANALTEPLPGSDSIGQSYDAFGFFANPRSIMKELFEFSPQEEIVVEGNTWLLSSDFVYTAIRDTETSTVSRRTKDDYSKELAVKVKLSGSYGFFSASVESDFSQSISDVTDTTYTSVRTHVNKWRLSLKDDVGALRSKLLPGFKQALATMDATQLFDTFGTHYVSEVLVGGRADYVATTKTSAFSSSTSISVAAEASFQSIAGGEVSPESKVLAETLRENSSTRLYALGGSALPNITDPATYNAWLQSIDTIPVFCGFTQNSLKPISELADSAQRRDALAKASQSYIPSYATRPAVVGLEVIISDSNSESPPYGYTRIDYDLNRNAGGKYVFLCYKQKNISVGGDADAITDVLVVYGNDRNPSVPSGYTKIDKDLNSGAGGKYIYFCYSKDKRKQEEGLPIRGLRVVGPHPTSVAPYGFSKIDIDLNMGAGGDFIYLCKSRHLE

SEQ ID NO: 133 - DNA, 1434 bp, Ophioglossum pendulum
atggaacccaacaaaggtggtgctccagccatgaaaaatgtagccaaaccttccacaaagagactcataccgtcatccattgctgcatcatcgcaaacatctgcaaatgcattaaccgagccattgcctggctctgatgccatcggccagagctacgatgcgttcgggttcttcgccaatcccagaagcatcatgaaggagttgtttgagttcagtcctcaagaggagatagtcgtggaaggaaatacctggcttctctcttcggacttcgtttacaccgcaattagagacactgagacctccacggtctcacgtcgcaccaaggacgactactccaaggaattggctgtgaaggtgaagctgtctggaagctatggctttttttctgcctccgttgagtctgatttctctcagagcatttccgatgtgacggacaccacatacacttcagttcgcacccacgtcaacaagtggaggctgagcctgaaggacgatgttggggcccttcgctcgaagctgctgcctggcttcaagcaggcgctggctaccatggatgctacgcagctctttgacacgttcgggactcactatgtgagcgaggtgcttgtgggtgggcgtgcagactacgttgccaccaccaagaccagcgcgttcagctcatccaccagcatcagcgtagcggcagaagcatcattccagtccatcgcgggtggggaggtgtctccggagtccaaggtgcttgcggagacgctgagagagaacagcagcacacgcctgtacgctcttggcgggagtgccctccccaacatcacagatccagccacgtacaacgcctggctgaagtccattgacaccatccctgtcttctgcggattcactcaaaacagcctcaagcccatctcggagcttgctgactccgctcaacgccgggacgctctggccaaagcctcccaaagctatatcccatcatacgtgactcgtcctgcagtggttggcttggaggtcataatatcggacagcaactcggagagccctccctatggctacaccagaatagactacgacctcaaccgcaacgcaggaggcaaatacgtgttcctctgctacaagcagaagtacatttcagtgggaggggatgccgatgccatcaccgacgtccttgtcgtctacggaaatgaccgaaatccatctgtgccgtctggctacaccaagatcgacaaggacctcaactccggggcaggcggtaagtatatctacatctgctactccaaggacaagtggaagcaagaggagggactgcccattcgtgggcttcgtgttgttgggcctgacgccaactcagtggcaccctacggattctctaagatcgacatagatctgaatatggatgcaggaggagattttatatacctctgcaaatcacgccatttggag

SEQ ID NO: 134 - protein, 478 aa, Ophioglossum pendulum
MEPNKGGAPAMKNVAKPSTKRLIPSSIAASSQTSANALTEPLPGSDAIGQSYDAFGFFANPRSIMKELFEFSPQEEIVVEGNTWLLSSDFVYTAIRDTETSTVSRRTKDDYSKELAVKVKLSGSYGFFSASVESDFSQSISDVTDTTYTSVRTHVNKWRLSLKDDVGALRSKLLPGFKQALATMDATQLFDTFGTHYVSEVLVGGRADYVATTKTSAFSSSTSISVAAEASFQSIAGGEVSPESKVLAETLRENSSTRLYALGGSALPNITDPATYNAWLKSIDTIPVFCGFTQNSLKPISELADSAQRRDALAKASQSYIPSYVTRPAVVGLEVIISDSNSESPPYGYTRIDYDLNRNAGGKYVFLCYKQKYISVGGDADAITDVLVVYGNDRNPSVPSGYTKIDKDLNSGAGGKYIYICYSKDKWKQEEGLPIRGLRVVGPDANSVAPYGFSKIDIDLNMDAGGDFIYLCKSRHLE

SEQ ID NO: 135 - DNA, 1434 bp, Ophioglossum pendulum
atggaacccaacaaaggtggtgctccagccatgaaaaatgtagccaaaccttccacaaagacactcataccgtcatccattgctgcatcatcgcaaacagctgcaaatgcattaaccgagccattgcctggctctgatgccatcggccagagctacgatgcattcgggttctttgccaatcccagaagcatcatgaaggagttgtttgagttcagtcctcaagaggagatagtcgtggaaggaaatacctggcttctctcttcggacttcgtttacaccgcaattagagacagtgaggccttcacgctctcacatcgcaccaaggacgactactccaaggaattggctctgaaggtgaagctgtctggaagctatggctttttttctgcctccgttgagtctgatttctctcagagcatttccgatgtgacggacaccacatacacttcagttcgcacccacgtcaacaagtggaggctgagcctgaaggacgatgttggggcccttcgctcgaagctgctgcctggcttcaagcaggcgctggctaccatggatgctacgcagctctttgacacgttcgggactcactatgtgagcgaggtgcttgtgggtgggcgtgcagactacgttgccaccaccaagaccagcgcgttcagctcatccaccagcatcagcgtagcggcagaagcatcattccagtccatcgcgggtggggaggtgtctccggagtccaaggtgcttgcggagatgctgagagagaacagcagcacacgcctgtacgctcttggcgggagtgccctccccaacatcacagatccagccacgtacaacgcctggctggagtccattgacaccatccctgtcttctgcggattcactcaaaacagcctcaagcccatctcggagcttgctgactccgctcaacgccgggacgctctggccaaagcctcccaaagctatatcccatcatacgtgactcgtcctgcagtggttggcttggaggtcataatatcggacagcaactcagagagccctccctatggctacaccagaatagactacgacctcaaccgcaacgcaggaggcaaatacgtgttcctctgctacaagcagaagaacatttcagtgggaggggatgccgatgccatcaccgacgtccttgtcgtctacggaaatgaccgaaatccatctgtgccgtctggctacaccaagatctacaaggacctcaactccggggcaggcggtaagtatatctacttctgctactccaaggacaagcggaagcaagaggagggactgcccattcgtgggcttcgtgttgttgggcctcacccaacctcagtggcaccttacggattctctaagatcgacatagatctgaatatgggtgcaggaggagattttatatacctttgcaaatcacgccatttggag

SEQ ID NO: 136 - protein, 478 aa, Ophioglossum pendulum
MEPNKGGAPAMKNVAKPSTKTLIPSSIAASSQTAANALTEPLPGSDAIGQSYDAFGFFANPRSIMKELFEFSPQEEIVVEGNTWLLSSDFVYTAIRDSEAFTLSHRTKDDYSKELALKVKLSGSYGFFSASVESDFSQSISDVTDTTYTSVRTHVNKWRLSLKDDVGALRSKLLPGFKQALATMDATQLFDTFGTHYVSEVLVGGRADYVATTKTSAFSSSTSISVAAEASFQSIAGGEVSPESKVLAEMLRENSSTRLYALGGSALPNITDPATYNAWLESIDTIPVFCGFTQNSLKPISELADSAQRRDALAKASQSYIPSYVTRPAVVGLEVIISDSNSESPPYGYTRIDYDLNRNAGGKYVFLCYKQKNISVGGDADAITDVLVVYGNDRNPSVPSGYTKIYKDLNSGAGGKYIYFCYSKDKRKQEEGLPIRGLRVVGPHPTSVAPYGFSKIDIDLNMGAGGDFIYLCKSRHLE

SEQ ID NO: 137 - DNA, 1434 bp, Ophioglossum pendulum
atggaacccaagacaggtggtgctccagccatgaaaaatgtagccaaaccttccacaaagagactcataccgtcatccattgctgcatcatcgcaaacatctgcaaatgcattaaccgagccattgcctggctctgatgccatcggccagagctacgatgcattcgggttcttcgccaatcccagaagcatcatgaaggagttgttcgagttcagtcctcaagaggagatagtcgtggaaggaaatacctggcttctctcttcggacttcgtttacaccgcaattagagacactgagacctccacggtctcacgtcgcaccaaggacgactactccaaggaattggctgtgaaggtgaagctgtctggaagctatggctatttttctgcctccgttgagtctgatttctctcagagcatttccgatgcgacggacaccacatacacttcagttcgcacccacgtcaacaagtggaggctgagcctgaaggacgatgttggggcccttcgctcgaagctgctgcctggcgtcaagcaggcgctggctaccatggatgctacgcagctctttgacacgttcgggactcactatgtgagcgaggtgcttgtgggtgggcgtgcagactacgttgccaccaccaagaccagcgcgttcagctcatccaccaacatcagtgcagtggcagaagcatcattcaagtccatcgcgggtggggaagtgtctccggagtacaaggagcttgtgcagacgctgagagagaacagcagcacacgcctgtacgctcttggcgggagtgccctctccaacatcacagattcagccacgtacaacgcctggcttaagtccattgacaccatccctgtcttctgcggattcactcaaaacagcctcaagcccatctcggagcttgctgactccgctcaacgccgggacgctctggccaaagcctcccaaagctatatcccatcatacgtgactcgtcctgcagtggttggcttggaggtcataatatcggacagcaactcggagagccctccctatggctacaccagaatagactacgacctcaaccgcaacgcaggaggcaaatacgtgttcctctgctacaagcagaagaacatttcagtgggaggggatgccgatgccatcaccgacgtccttgtcgtctacggaaatgaccgaaatccatctgtgccgtatggttacaccaaaatcgacaaggaccttaactgcggggcaggaggcaagtatatctacatctgctactccaaggacaagtggaggcaagaggagggactgcccattcgtgggcttcgtgttgttgggcctgacccgaactcagtggcaccttacggattctctaagatcgacatagatctgaatatgggtgcaggaggagatttcatatacctttgcaaatcacgccatttggag

SEQ ID NO: 138 - protein, 478 aa, Ophioglossum pendulum
MEPKTGGAPAMKNVAKPSTKRLIPSSIAASSQTSANALTEPLPGSDAIGQSYDAFGFFANPRSIMKELFEFSPQEEIVVEGNTWLLSSDFVYTAIRDTETSTVSRRTKDDYSKELAVKVKLSGSYGYFSASVESDFSQSISDATDTTYTSVRTHVNKWRLSLKDDVGALRSKLLPGVKQALATMDATQLFDTFGTHYVSEVLVGGRADYVATTKTSAFSSSTNISAVAEASFKSIAGGEVSPEYKELVQTLRENSSTRLYALGGSALSNITDSATYNAWLKSIDTIPVFCGFTQNSLKPISELADSAQRRDALAKASQSYIPSYVTRPAVVGLEVIISDSNSESPPYGYTRIDYDLNRNAGGKYVFLCYKQKNISVGGDADAITDVLVVYGNDRNPSVPYGYTKIDKDLNCGAGGKYIYICYSKDKWRQEEGLPIRGLRVVGPDPNSVAPYGFSKIDIDLNMGAGGDFIYLCKSRHLE

SEQ ID NO: 139 - DNA, 1434 bp, Ophioglossum pendulum
atggaacccaagacaggtggtgctccagccatgaaaaatgtagccaaaccttccacaaagagactcataccgtcatccattgctgcatcatcgcaaacatctgcaaatgcattaaccgagccattgcctggctctgatgccatcggccagagctacgatgcgttcgggttcttcgccaatcccagaagcatcatgaaggagttgtttgagttcagtcctcaagaggagatagtcgtggaaggaaatacctggcttctctcttcggacttcgtttacaccgcaattagagacactgagacctccacggtctcacgtcgcaccaaggacgactactccaaggaattggctgtgaaggtgaagctgtctggaagctatggctatttttctgcctccgttgagtctgatttctctcagagcatttccgatgcgacggacaccacatacacttcagttcgcacccacgtcaacaagtggaggctgagcctgaaggacgatgttggggcccttcgctcgaagctgctgcctggcgtcaagcaggcgctggctaccatggatgctacgcagctctttgacacgttcgggactcactatgtgagcgaggtgcttgtgggtgggcgtgcagactacgttgccaccaccaagaccagcgcgttcagctcatccaccagcatcagcgtagcggcagaagcatcattccagtccatcgcgggtggggaggtgtctccggagtccaaggtgcttgcggagatgctgagagagaacagcagcacacgcctgtacgctcttggcgggagtgccctccccaacatcaccgattcatccacgtacaacgcctggctgaagtccattgacaccatccctgtcttctgcggattcactctgaacagcctcaagcccatctcggagcttgctaactccgctcaacgccgggacgctctggcgaaagcctcccaaagctatatcccatcatacgtgactcgacctgcagtggttggcttggaggtcataatatcagacagctactgggagagccctccctatggctacaccaaaatcaactacgacctcaaccgcaacgcaggaggcaaatacgtgttcctctgctacaagcagaagaacatatcagtgggacgagatgccgataccataaccgacgtccatgtcatctacggagatggcccaaatccatctgtgccgtatggttacaccaaaatcgacaaggaccttaactgcggggcaggaggcaagtatatctacatctgctactccaaggacaagtggaggcaagaggagggactgcccattcgtgggcttcgtgttgttgggcctcacccaacctcagtggcaccttacggattctctaagatcgacatagatctgaatatgggtgcaggaggagattttatatacctttgcaaatcacgccatttggag

SEQ ID NO: 140 - protein, 478 aa, Ophioglossum pendulum
MEPKTGGAPAMKNVAKPSTKRLIPSSIAASSQTSANALTEPLPGSDAIGQSYDAFGFFANPRSIMKELFEFSPQEEIVVEGNTWLLSSDFVYTAIRDTETSTVSRRTKDDYSKELAVKVKLSGSYGYFSASVESDFSQSISDATDTTYTSVRTHVNKWRLSLKDDVGALRSKLLPGVKQALATMDATQLFDTFGTHYVSEVLVGGRADYVATTKTSAFSSSTSISVAAEASFQSIAGGEVSPESKVLAEMLRENSSTRLYALGGSALPNITDSSTYNAWLKSIDTIPVFCGFTLNSLKPISELANSAQRRDALAKASQSYIPSYVTRPAVVGLEVIISDSYWESPPYGYTKINYDLNRNAGGKYVFLCYKQKNISVGRDADTITDVHVIYGDGPNPSVPYGYTKIDKDLNCGAGGKYIYICYSKDKWRQEEGLPIRGLRVVGPHPTSVAPYGFSKIDIDLNMGAGGDFIYLCKSRHLE

SEQ ID NO: 141 - DNA, 1434 bp, Ophioglossum pendulum
atggaacccaacaaaggtggtgttccacccatgaaaaatgtagccaaaccttccactaagagactcataccgtcatcctttgctagatcgttgcaaacatctgcaaatgcatcaatcgagccattgcctggttctgatgctatcggcaatagctacgatgcattcgggtactttgccaatcccagaagcatcatgaaggaattgtttcagttcagtccacaaaaggagatagtggtggaaggaaatacctggcttctctcttctgacttcgtttacaccgcaattagagacactgagactttcacagtctcacatcgcaccaaggacgactactccacggaattggctctgaaggtgaagctgtctggaagctatggcttattttccgcctccgttcagtctgatttctctcagagcatttccgatgtgacggacaccacatacacttcagttaacaccaacgtcaacaagtggaggctgagcctgaaagacaatgttggggcccttcgcgcgaagctgctgcctgacttcaagcaggcgctggctaccatggatgctacgcccctctttgatacgtatgggactcactatgtgagcgaggtgcttgtgggtgggcgtgcagactacgttgccaccaccaagaccagcgcgttcagctcatccaccaacatcagtgcagtggcagaagcatcattcaattccatcgcgggtggggaagtgtctgcggagtacaaggagcttgtgcagacgctgagagagaacagcagcacacgcctgtacgctcttggcgggagtgccctctccaacatcacagattcagccacgtacaacgcctggcttaagtccattgacaccatccctgtcttctgcggatttactctaaacagcctcaatcccatctcagaacttgctgactccgctcaacgccgggacgctctggccaaagcctcccagagctatatcccatcatacgtgactcgtcctgcagtggttggcttggaggtcataatatcggacagctactgggagaaccctccctatggctacaccaaaatcaactacgacctcaaccgcaacgcaggaggccaatacgtgttcctgtgctacaagcagaagaacatatcagtgggaggagatgccgatgccatcaccgacgtccatgtcgtctacggagatggcccaaatccatctgtgccgtctggttacaccaagatagacaaggacctcaactgcggggcaggaggtaagtatatctacatctgctactccaaggacaagtggaagcaagaggagggactgcccattcgtgggcttcgtgttgttgggcctgacgccaactcagtggcaccctacggattctctaagatcgacatagatctgaatatggatgcaggaggagattttatatacctttgcaaatcacgccatttggag

SEQ ID NO: 142 - protein, 478 aa, Ophioglossum pendulum
MEPNKGGVPPMKNVAKPSTKRLIPSSFARSLQTSANASIEPLPGSDAIGNSYDAFGYFANPRSIMKELFQFSPQKEIVVEGNTWLLSSDFVYTAIRDTETFTVSHRTKDDYSTELALKVKLSGSYGLFSASVQSDFSQSISDVTDTTYTSVNTNVNKWRLSLKDNVGALRAKLLPDFKQALATMDATPLFDTYGTHYVSEVLVGGRADYVATTKTSAFSSSTNISAVAEASFNSIAGGEVSAEYKELVQTLRENSSTRLYALGGSALSNITDSATYNAWLKSIDTIPVFCGFTLNSLNPISELADSAQRRDALAKASQSYIPSYVTRPAVVGLEVIISDSYWENPPYGYTKINYDLNRNAGGQYVFLCYKQKNISVGGDADAITDVHVVYGDGPNPSVPSGYTKIDKDLNCGAGGKYIYICYSKDKWKQEEGLPIRGLRVVGPDANSVAPYGFSKIDIDLNMDAGGDFIYLCKSRHLE

SEQ ID NO: 143 - DNA, 1614 bp, Selaginella victoriae
atggaggactccaaagctcttacacctacaggctcagatgacaaccatagcggatctcaagccaccatcgcaggcacagaagaagtcattggggctgcgtcagactatgacaccctccctggctgtgaaatcatcggttgtggttatgatgtccttaatggacgctatgccgatgcaaccagctgccgcagcaacctcttcgacattcccaaggagtacgagacggtgaagatcgcagacaggtacttctcaaaaccagaacagatcgtctaccagtcgaacatacaggtgctggagtacacatccaaggggagcagcatcactgaatacactgaaagtgtcacgtccaagataaaggtggagggtaagtacaacttcttctccgcagaggtggaggcttctataggcatgagttcggcccaaaacctgcagaacgaatttgtccagcttcagcaaactgtgagttactacaacctccagttgccagtcaaccacaaggatttgctcaagccaagcgtcaaggatgacattgataacatcgaaaatactgccgagctgttcgacagatatggcacgcactacctcgcggggatcatcatgggtggctcggctatgtacacatcaaccacgaacaagatgagcttcgagtcaagcactgaactcgatgtggtagccaaaatgtcttacgatgagctcgtgggcagcattagtgccgaggacaggacaaaatacgagcaaaaaatcaagaacttcagagaatcgagcactactgaattgcacaacaaaggtggagaccctggtcttagtggtcaaaatttccccgcaaatgccgaggaatggaataagagcgtgatagattatctggccttctgcgagttcctctccagtgaccaaagcctgttggggatctgggagctggcctccacacctgcacgctccaagcaaatacaagactcctaccatgactactgccgcgacaaacaaaccaagtacaatgtggaccctccatacctccaggccaagatcgtcccactcaagagggtccagttcacagacacggggagccatgcccatgactacttgaccgtgtgcattcccgacgtcgactcaggttggtattaccttggtcaagtggctttcccaggaggaggtgccagaggaagcacaattgtggtgaaggagctggtggcaggcgctcttatagacgtcaagtggtggcaatgggtgtgggacgacgctggatcccacaacagcaaggacttcagcctctggtacggcaactctgccaatccggtggagtactacgtgctgggtgacttcttcagaggtggagtcgagcatacttctccagtaagcgcaccaactgcaaacgaggtggctggcatcaaggccgtgagcagcaaatgtgtggtcgaagccacagtgggagaccgaatctggcatgatgaggggacccatgcaacatatgatggtagtgtctggaagatcatccccaaaagcggatccaatgctatcgacacgagcaacatggacctttacttcatcgcttcaggatcatgggacaagcctaatcgtcccgtttacctgctcaacaaggatgctgtcgagtttgtc

SEQ ID NO: 144 - protein, 538 aa, Selaginella victoriae
MEDSKALTPTGSDDNHSGSQATIAGTEEVIGAASDYDTLPGCEIIGCGYDVLNGRYADATSCRSNLFDIPKEYETVKIADRYFSKPEQIVYQSNIQVLEYTSKGSSITEYTESVTSKIKVEGKYNFFSAEVEASIGMSSAQNLQNEFVQLQQTVSYYNLQLPVNHKDLLKPSVKDDIDNIENTAELFDRYGTHYLAGIIMGGSAMYTSTTNKMSFESSTELDVVAKMSYDELVGSISAEDRTKYEQKIKNFRESSTTELHNKGGDPGLSGQNFPANAEEWNKSVIDYLAFCEFLSSDQSLLGIWELASTPARSKQIQDSYHDYCRDKQTKYNVDPPYLQAKIVPLKRVQFTDTGSHAHDYLTVCIPDVDSGWYYLGQVAFPGGGARGSTIVVKELVAGALIDVKWWQWVWDDAGSHNSKDFSLWYGNSANPVEYYVLGDFFRGGVEHTSPVSAPTANEVAGIKAVSSKCVVEATVGDRIWHDEGTHATYDGSVWKIIPKSGSNAIDTSNMDLYFIASGSWDKPNRPVYLLNKDAVEFV

SEQ ID NO: 145 - DNA, 1356 bp, Artificial Sequence
  maize codon optimized
atggcagcccagatcgagcctcttcccggctcagacgcaatcggcctcagctacgacgtcttcggcttctacgccaacccgaagtcggtcaaccgccagctgttcgacttcgcgccgcagcaggagatcaccctggaggaccacacctggctgctgagcaccgacatcgtctacatcgcggtccgcgacaccgacatcaacaccgtctcgctccgcaccaaggacgcgtactccactgagctcgcagcatccgtcaaggtctccggcagctacggcagcttcagcgcctccgtcgagtccgacttcagccagtccatctccgacgagaccgactccacctacacgtccgtccggaccaacgtcaacaagtggaagctcagcctcaagccgaccgtcgaggagctccgctcgatgctcacgcccagcttcaaggaggcgctcgcctcgatgaactccgaggagctcttcaccacgtacggcacgcactacctcaacgaggtcctcgtcggaggcagagcggactacgtcgccaccaccaagacgtccgccttcagctccgacaccaagatctccgtcgtcgccgagtccagcttcaagagcgtcgccggcatggaagtctccgcggagtacaaggagctcatcaagaagttccaggagaactccagcacctcgctctacgctctcggaggcactgcgctcagctccatcacggacaccgcgtcctacaacgcctggttcagctccatcgacacgctgcccgtcttctgcggcttcacctacgagagcctccagccgatctgggaactcgccgagtcgccacagcgccaggagatcctccagaaggccacgaagaccttcatcccgcccgagatccgccggaacgccatcgtcgacgtcgacatcatcgtctccgacaactactgggtcaacccgccgtacggctacaccaagatcgactacgacctcaaccggaacgcgaagggcaagtacatcttcctctgctacaaccagcagaagatctcggtcgccggatcacctgccgatccgactcccatcacggcactctacgtcgcgtcaggcgatgacgaccatccgtacgtcccgctcggctacacgcgcatcaactccgacctgaacgagggcgctggcggcaagtacatctacctgtgctacacgaaggacccggcagccatcccttccgacgaggatggcctgcccatcagaggcatccgcgtgatcggcaacgagaaggtcgagaacgtcgtgacgccctacggcttcaccaagatcgacaaggacctgaacgagggtgctggcggcgactacatcttcgtctgcttcagccgccacctggac

SEQ ID NO: 146 - DNA, 1356 bp, Artificial Sequence
  maize codon optimized
atggctgcccagatcgagccgctcccgggctccgacgcgatcggcctctcctacgacgtgttcggcttctacgcgaaccccaagtcggtgaaccgccagctcttcgacttcgcgccgcagcaggagatcaccctggaggaccacacgtggctcctgagcaccgacatcgtctacatcgccgtccgcgacacggacatcaacacggtgtcgctgcggaccaaggacgcctactccaccgagctcgccgcgtccgtgaaggtctccgggtcctacgggagcttctccgccagcgtcgagtcggacttcagccagtccatctcggacgagacggactccacgtacacctcggtccggaccaacgtcaacaagtggaagctctcgctgaagcccacggtggaggagctccggtccatgctcacgccctcgttcaaggaggccctcgcgtccatgaactccgaggagctcttcacgacctacggcacgcactacctgaacgaggtgctcgtgggcggccgggccgactacgtggcgaccaccaagacgtccgccttcagctccgacaccaagatctccgtcgtcgccgagtcgagcttcaagtcggtggcgggcatggaggtcagcgccgagtacaaggagctcatcaagaagttccaggagaactcctcgacgtcgctctacgcgctcggcggcacggccctgtccagcatcaccgacacggcgtcgtacaacgcctggttcagcagcatcgacacgctgccggtcttctgcgggttcacctacgagtcgctccagccgatctgggagctcgcggagagcccgcagcgccaggagatcctccagaaggcgaccaagacgttcatcccgccggagatccgcaggaacgccatcgtcgacgtcgacatcatcgtctcggacaactactgggtgaaccccccgtacggctacaccaagatcgactacgacctcaaccggaacgcgaagggcaagtacatcttcctgtgctacaaccagcagaagatctccgtcgccggcagccccgcggaccccacgcccatcacggcgctctacgtcgcctccggagacgacgaccacccgtacgtgcccttgggctacacccggatcaactcggacctgaacgagggcgccggcggcaagtacatctacctgtgctacacgaaggacccggccgcgatcccgtcggacgaggacgggctgccgatccgcggcatccgggtcatcggcaacgagaaggtcgagaacgtcgtgacgccgtacgggttcaccaagatcgacaaggacctcaacgagggcgccggcggcgactacatcttcgtctgcttctcgcggcacctcgac

SEQ ID NO: 147 - DNA, 1356 bp, Artificial Sequence
  maize codon optimized
atggcagcacagatcgagccgcttcctgggtcggacgcgatcggcctctcctacgacgtcttcggcttctacgcgaaccccaagtccgtcaaccgccagctcttcgacttcgcgccgcagcaggagatcaccctcgaggaccacacctggctgctctcgacggacatcgtttacatcgccgtgcgcgacacggacatcaacaccgtctcgctccgcacgaaggacgcgtactcgacggagctcgcagcgtcagtcaaggtctccgggtcctacgggagcttctccgcgtctgtggagagcgacttctcccagagcatcagcgacgagacggactccacctacacctcggtccgcaccaacgtcaacaagtggaagctctcgctcaagccaaccgtcgaggagctcaggtcgatgctgacgccgtcgttcaaggaggccctggccagcatgaactcggaggagctgttcaccacgtacgggacccactacctgaacgaggtcctcgttggcggcagggcggactacgtggccaccacgaagacctcggccttcagctcggacaccaagatctccgtggtcgcggagagctccttcaagtcggtggccggcatggaggtctcggcggagtacaaggagctcatcaagaagttccaggagaactcgtccacctctctctacgccctgggagggacggcgctgtcgtcgatcaccgacaccgccagctacaacgcgtggttctcctccatcgacaccctcccggtgttctgcgggttcacgtacgagagcctgcagccgatctgggagctcgcggagagcccacaacgccaggagatcctgcagaaggcgacgaagacgttcatcccgccagagatccggcggaacgcgatcgtcgacgtcgacatcatcgtgtcggacaactactgggtcaacccgccctacggctacaccaagatcgactacgacctgaaccgcaacgcgaaagggaagtacatcttcctctgctacaaccagcagaagatctccgtcgccggatcgccagccgaccctactccgatcaccgcgctgtacgtcgcatctggggacgacgaccacccgtacgtcccactcgggtacacgcgcatcaactcggacctcaacgagggcgccggcgggaagtacatctacctctgctacaccaaggacccggccgcgattccgtcggacgaggacgggctcccgatacgcggcatccgcgtcatcgggaacgagaaggtggagaacgtcgtcacgccgtacgggttcaccaagatcgacaaggacctgaacgagggcgcaggcggcgactacatcttcgtgtgcttcagccggcacctggac

SEQ ID NO: 148 - DNA, 1356 bp, Artificial Sequence
  maize codon optimized
atggctgcacagatcgagcccttgccaggctcagacgcgatcggcctctcctacgacgtcttcggcttctacgcgaaccctaagtccgtgaaccggcagctcttcgacttcgcgccgcagcaggagatcacgctcgaggaccacacctggctcctgagcaccgacatcgtgtacatcgccgtccgcgacacggacatcaacacggtgtccctcaggaccaaggacgcctactcgacggagctggccgcctcggtgaaggtgtcgggaagctacgggagcttctcagcctccgtcgagagcgacttcagccagagcatcagcgacgagaccgactcgacgtacacctccgtccggacgaacgtgaacaagtggaagctgtccctgaagcccacggtcgaagagctgcggtccatgctcacgccgtccttcaaggaggcgctggcctccatgaactcggaggagctcttcaccacctacggcacccactacctgaacgaggtgctcgtcggaggtagggcggactacgtcgccaccaccaagacctcggccttctcgagcgacacgaagatctccgtcgtggcggagtcctcgttcaagtccgtggcgggcatggaggtgagcgcggagtacaaggagctcatcaagaagttccaggagaactcgtcaacctcgctctacgcgttgggcgggaccgcgttgtcctcgatcacggacaccgccagctacaacgcctggttctcgagcatcgacaccctccccgtcttctgcgggttcacctacgagtcgttgcagcccatctgggagctggccgagagcccgcagaggcaggagatcctgcagaaagcgaccaagacgttcatcccgcccgagatccggcgcaacgcgatcgtcgacgtggacatcatcgtctccgacaactactgggtgaacccgccctacggctacaccaagatcgactacgacctgaaccggaacgcgaagggcaagtacatcttcctctgctacaaccagcagaagatcagcgtggccggaagccctgccgatccaacgcccatcacggcgttgtacgtcgcgtcaggcgacgacgatcacccgtacgtgccgctcggctacacgaggatcaactcggacctgaacgagggagctggcgggaagtacatctacctctgctacaccaaggaccctgctgccatcccgtcggacgaggacggcttgccgatccgcggcatcagggtcatcgggaacgagaaggtcgagaacgtcgtcacgccctacggcttcaccaagatcgacaaggacctgaacgagggcgctggcggagactacatcttcgtctgcttctcccgccacctcgac

SEQ ID NO: 149 - DNA, 1437 bp, Artificial Sequence
  maize codon optimized
atggcagagcccaacaagggtggagcgcctgcgatgaagaacgtcgccaagcccagcaccaagcggctgatccctagctcgatagccgcgtcgtctcagacgtccgcgaatgctctcaccgagccactccctggatcggacgccatcggacagtcgtacgacgccttcggcttcttcgccaatccccgcagcatcatgaaggagctcttcgagttcagcccccaggaggagatcgtggtcgagggcaacacctggctgctcagcagcgacttcgtctacaccgccatccgcgacacagagacgagcaccgtgtccaggcgcaccaaggacgactactccaaggagctcgcagtgaaggtcaagctcagcggcagctacggctacttcagcgccagcgtcgagtcggacttcagccagagcatctcggacgcgaccgacactacctacaccagcgtgcgcacccacgtcaacaagtggcgcctcagcctcaaggacgacgttggagccctcaggtccaagctgctgccaggcgtcaagcaggcccttgccacgatggacgctacccaactgttcgacaccttcggcacccactacgtcagcgaagtcctcgtcggaggaagggccgactatgtcgccaccacgaagacctcggccttcagcagctcgaccagcatctcagtcgccgctgaagcctcgttccagagcatcgctggaggcgaggtgagccccgagtcgaaggtgctcgctgagatgctccgcgagaactcgagcacacgcctgtatgccctcggaggtagcgcacttcccaacatcaccgaccccgcgacctacaacgcctggctggagagcatcgacaccatccccgtcttctgcggcttcacccagaactcgctcaagtccatcagcgagctcgccgatagcgcccaaaggcgcgatgcgctggcaaaggcctcccagtcctacatccccagctacgtcactcggcctgcagttgtcggcctcgaggtgatcatctccgactcgaactcggagtctccaccatacggctacacccggatcgactacgacctcaaccggaacgctggcgggaagtacgtcttcctctgctacaagcagaagaacatctcggtcggcggagacgcggatgccatcactgacgtcctcgtcgtctacggcaacgaccggaatccgagcgtgccatccgggtacacgaagatcgacaaggacctgaactcgggagctggcgggaagtacatctacttctgctactcgaaggacaagcgcaagcaggaggagggccttccgatacgcggtctcagagtcgtcggacctcaccctacctcggtcgcgccgtacggcttcagcaagatcgacatcgacctgaacatgggcgctggtggagacttcatctacctgtgcaagtcgcgccacctggag

SEQ ID NO: 150 - DNA, 1437 bp, Artificial Sequence
  maize codon optimized
atggccgaaccgaacaagggcggagcgccagcgatgaagaacgtcgccaagccgagcacgaagcgcctgatccctagctcgattgccgccagctctcagaccagcgccaacgcactcaccgaaccactgccaggctcggatgccatcggacagtcgtacgacgccttcggcttcttcgccaacccgcgcagcatcatgaaggagctcttcgagttcagcccgcaggaggagatcgtcgtggaaggcaacacctggctcctctcgagcgacttcgtctacaccgccatccgggacacagagaccagcacggtctcgaggcgcaccaaggacgactacagcaaggagctcgccgtgaaggtgaagctcagcggcagctacggctacttcagcgcaagcgtcgagtccgacttcagccagagcatctccgacgcgaccgacaccacctacaccagcgtgcggacgcacgtcaacaagtggcggctcagcctcaaggacgacgtgggtgcactccgcagcaaactccttcccggagtcaagcaggcacttgcaacgatggacgcaacccagctcttcgacacgttcggcacgcactacgtcagcgaggtcctcgtcggaggtagagccgactacgtcgccaccaccaagacgtcggccttcagcagctccacgtcgatctcagtcgcagccgaagcctccttccagagcatcgcaggaggagaggtcagccctgagtccaaggtccttgccgagatgctccgcgagaactcgagcaccaggctctacgccctcggaggaagcgcactcccgaacatcaccgacccagcgacgtacaacgcgtggttggagagcatcgacaccatccccgtcttctgcggcttcacccagaactccctcaagagcatcagcgagctcgccgacagcgcacagaggagagacgctctcgccaaagcctcgcagtcgtacatccccagctacgtcacgagaccagcagtcgtcggactcgaggtcatcatcagcgactcgaactcggagtcaccaccctacggatacacgcgcatcgactacgacctcaaccgcaacgcaggcgggaagtacgtcttcctctgctacaagcagaagaacatcagcgtgggaggcgacgcagatgccatcacggacgttctcgtcgtctacggcaacgacaggaaccccagcgtccctagcggctacaccaagatcgacaaggacctgaactccggagcaggtgggaagtacatctacttctgctacagcaaggacaagcgcaagcaggaggaggggctccctatcagaggtctgcgcgttgtcggaccacaccctacgagcgttgcaccgtacggcttcagcaagatcgacatcgacctcaacatgggcgctggaggcgacttcatctacctctgcaagagccgccacctcgag

SEQ ID NO: 151 - DNA, 1437 bp, Artificial Sequence
  maize codon optimized
atggcggagcccaacaagggaggagcacccgcgatgaagaacgtggccaagccaagcaccaagaggctgatcccgagctcaatcgccgcgagctctcagaccagcgctaacgcgctgaccgaaccactgccagggtcagacgcgatcggacagtcctacgacgccttcggcttcttcgccaacccacgcagcatcatgaaggagctcttcgagttcagcccacaggaggagatcgtcgtcgagggtaacacctggctgctctcgtccgacttcgtctacaccgccatacgcgacaccgagacctccacagtctccaggcgcaccaaggacgactactccaaggagctggccgtcaaggtcaagctcagcggcagctacggctacttcagcgcatccgtcgagtcggacttcagccagtcgatctccgacgcgaccgacacgacctacacctccgtcaggacgcacgtcaacaagtggcgcctcagcctcaaggacgacgttggcgcactcaggtcgaagctccttcccggcgtcaagcaggcactcgctacgatggacgcaacccagctgttcgacacgttcggcacgcactacgtctccgaggtccttgtcggcggtagagcggactacgtcgccaccaccaagacgagcgccttcagcagctcgacgtccatctcagttgcagccgaggcgtctttccagagcatagctggcggtgaggtgagccctgagtccaaggtccttgcggagatgctgcgcgagaactcgtcgacgagactgtacgcacttggcggtagcgcactgccgaacatcacggaccctgcgacgtacaacgcctggcttgagagcatcgacaccatcccggtcttctgcggcttcacccagaactcgctcaagagcatctcggagctcgccgactcagctcagcgcagggatgcgctcgctaaggcatcccagtcgtacatcccgtcctacgtcaccagacctgcagtcgttgggctcgaggtgatcatctcggactccaactcggagtcgcctccatacggttacacgcgcatcgactacgacctcaaccgcaacgccggtggcaagtacgtcttcctgtgctacaagcagaagaacatctccgtcggtggcgacgcagacgccatcactgacgtcctcgtggtctacggcaacgatcgcaacccctcagtgccctcaggctacacgaagatcgacaaggacctcaactccggcgctggcgggaagtacatctacttctgctactcgaaggacaagcggaagcaggaggagggcctccccatacgcggtcttcgcgttgtcggaccacatccgacgtcagtggcaccctacggcttctccaagatcgacatcgacctcaacatgggcgcaggtggcgacttcatctacctctgcaagtcccggcatctggag

SEQ ID NO: 152 - DNA, 1437 bp, Artificial Sequence
  maize codon optimized
atggcagagccgaacaagggtggagcacctgcgatgaagaacgtcgccaagccgtcgaccaaacgcctgatcccgagctcgatagccgcttcgagccagactagcgccaacgctctgacggagccccttcctgggtctgacgcgatcggccagagctacgacgcattcgggttcttcgccaatccccgcagcatcatgaaggagctgttcgagttcagcccacaggaggagatcgtcgtcgaaggcaacacctggcttctcagcagcgacttcgtctacaccgccatccgcgacacagagacctcgaccgtctcgaggcgcaccaaggacgactacagcaaggagctggccgtgaaggtgaagctcagcggaagctacggctacttcagcgctagcgtggagagcgacttcagccagagcatcagcgacgctaccgacacgacgtacaccagcgtccgcacccacgtcaacaagtggcgcctcagcctcaaggacgacgtcggagctctccggagcaagctccttcctggtgtcaagcaggctctcgctacgatggacgcaacccagctcttcgacacgttcggcacccactacgtcagcgaggtcctcgtcggtggaagagccgactacgtcgccaccaccaagaccagcgccttcagctcgagcacctccatcagcgtcgctgcagaggcgtcgtttcagagcatcgcaggaggcgaagtcagccccgagagcaaggtcctcgccgagatgctgcgcgagaactccagcacacggctctacgcactgggaggctcagcactcccgaacatcacggacccagcgacctacaacgcctggctggagagcatcgacaccatcccggtcttctgcggcttcacccagaactccctcaagtcgatcagcgagctcgcggattcagcccaacgcagagacgcactcgcgaaggcatcccagtcgtacatccccagctacgtcactcgcccagcagtcgtgggcctcgaggtcatcatctccgactccaactccgagagccctccatacggctacacccggatcgactacgacctcaaccgcaatgccggaggcaagtacgtcttcctctgctacaagcagaagaacatctccgtcggaggtgacgcagacgcgatcacggacgtcctcgtcgtctacggcaacgaccggaacccaagcgtgccctcaggctacaccaagatcgacaaggacctgaactccggagctggagggaagtacatctacttctgctactccaaggacaagcgcaagcaggaggagggccttccgatacgcggacttcgcgtcgttggaccacaccctacgtcagtggcaccgtacggcttcagcaagatcgacatcgacctcaacatgggcgcaggtggggacttcatctacctctgcaagtcgcggcacctcgag

SEQ ID NO: 153 - DNA, 1437 bp, Artificial Sequence
  maize codon optimized
atggcggagccgaacaagggcggagcaccagcgatgaagaacgtggccaagcccagcacgaaacgcctgatccctagctcgatcgcagctagctctcaaaccagcgccaacgcgttgacagagccgttgcccggatctgacgccatcggacagtcgtacgacgccttcggattcttcgcgaacccacgctccatcatgaaggagctcttcgagttctcgccacaggaggagatcgtcgtcgagggaaacacgtggctgctctcctcagacttcgtctacaccgccatccgggacacagagacctcaacggtcagcaggaggaccaaggacgactactccaaggagctcgccgtgaaggtcaagctcagcggatcgtacggctacttcagcgcgtcagtggagtccgacttcagccagagcatctcagacgcgaccgacaccacctacaccagcgtcaggacccacgtcaacaagtggcggctcagcctcaaggacgacgtcggagcactcaggagcaagctgcttcccggtgtcaagcaggcactggcgacgatggacgcaactcagctcttcgacaccttcggaacccactacgtgagcgaagtcctggtcggtggcagagcagactacgtcgcgaccacgaagacgtccgccttcagcagctccacgtcgatcagcgtcgctgcagaggcttccttccagtccatcgccggaggagaagtctcgccagagtccaaggttctggcggagatgctgcgcgagaactcctcgactaggctgtacgcactcggaggtagcgcactcccgaacatcacggacccagcgacctacaacgcctggctcgagtccatcgacacgatccccgtgttctgcggcttcacccagaactccctcaagtcgatctccgagctcgccgacagcgcacaaaggcgcgatgcactcgcaaaggctagccagagctacatccccagctacgtcaccagacctgcagtcgtcggcctcgaggtcatcatctccgactcgaacagcgagtccccaccctatggctacacccgcatcgactacgacctgaaccggaacgccggagggaagtacgtcttcctctgctacaagcagaagaacatctccgtcggtggagacgctgacgccatcactgacgtgctcgtcgtctacggcaacgaccgcaacccatcggtcccatccggctacaccaagatcgacaaggacctcaactctggcgcaggtgggaagtacatctacttctgctacagcaaggacaagcgcaagcaggaggagggccttcccatacgcggacttcgcgtcgttggacctcacccaacgtctgtcgcaccatacggcttcagcaagatcgacatcgacctcaacatgggcgcgggaggagacttcatctacctctgcaagtcgcggcacctggag

SEQ ID NO: 154 - DNA, 25 bp, Artificial Sequence
  cloning primer
gattacgaattcgcccaaatagagc

SEQ ID NO: 155 - DNA, 26 bp, Artificial Sequence
  cloning primer
gctaactcgagctagtctaaatgacg

SEQ ID NO: 156 - DNA, 41 bp, Artificial Sequence
  cloning primer
gctgcagggatcgagggaagggaacccaacaaaggtggtgc

SEQ ID NO: 157 - protein, 5 aa, Artificial Sequence
  fusion protein linker
EEKKN

SEQ ID NO: 158 - protein, 342 aa, Tupidanthus calyptratus
MSSSTSTSSSSSSSGDGIVWRAINSLGKGFDLTSDFRLKYCKGNHPLVLLNQTHTKQLLVPGFGYFNHVSSDINCGKGERTRYQSDILDFNQMSEFMNQRSSVPGKIPSGLFNSMFGFESESWAKEAASTKCLGLDAYFISLFHLRINRYPLVLCDEVRNAVPSTWDPSALARFIEKYGTHIIVSLGIGGQDTVVVRQDKSSNLEASDLKKYLDQLGDQLFTGTCTFTPKQRNHKAPAAFNVFDHQSTLFDNFSSVKTKNGVNVICSKRGGDVSAHTHCEWLLTVPSMPDAIQFSFIPITSLLKGVPGNGFLTHAINLYLRCDDGKETSNRDAVISRRHEMQ

SEQ ID NO: 159 - protein, 253 aa, Vernonia noveboracensis
MGSSNKEVALRLKAAAESAIGAIGLGYDVTEDLRLKYCKGKSAADRLIGIDDERVRDILIPGGILIQNVSKSINCDKGERMRFSSDILPFQQMAEQFNKDVSLTGRIPTGQFNAAFEFTGSWQKDAANTKALALDGVFITLYNITLEKSQIALRDHVKYDVPSSWEPAALAKFIEKFGTHVIVGVKMGGKDIVYMKQQQLSTLPSDEVQKKLKDVAEKRFSGLHVDNPRRTHDPELVVTSLPMISYNLLALCS

SEQ ID NO: 160 - protein, 266 aa, Tupidanthus calyptratus
MEGGEETVKPIGLRAMESLGLGFDFASDFRLKFAKRCPGAGGDDRLVVLDEASRRDVVFPGGGVIRGVPECIRCDKGDRIRFKSDVLKFNQMSELVNQKSSVQGKVPSGYFNAMFDLSGSWFNDAADSNHLAFDGYFISLYYLHLIASPLVLRDKVKNSVPSHWNPASLSRFILTYGTHIIVGLAVGGQDVICVKQRPSSGIPPAELRGYLEDLGDCMFSDGRNPVLERKTRDGKQKVPEVFNRMLQSHTMQFSSITETSSKDVRL

SEQ ID NO: 161 - protein, 598 aa, Dryopteris erythrosora
MASGKDAAALAAVEALGCGFDLTSDYRLKYRKGPLLHLQQSHNKDLTIPGGITIQDVSRDVKCDKGERIRFASEVMQFQQMSQLFNQNASVEGKIPLGLFNAMFDLSGSWQDDANQIKSLAFDGCFITLYKLHLTRSNLVLREEVKKDIPSVWDPQSLAKFIEKYGTHIIVSASVGGQDVLYLKENYYSLLTAQDIHKKLKSAGEDYFSDSGGKRNTNFKDCETLPLNALNSQPFRGTIANTHSAQLLITNKDFTIISQRRGGFHFAKTHCEWQETVNIVPEAISLSFVPITSLLLGVAGSGFLQHAINLYLRYKPPVNDLQYFLDFQVPRQWIPIHNELPLRLARKQVFSPSLQFSLTSPKLYINNNEVVVNKKPVTGIRLYLEGRKSNRLAIHLQHLSVLPQSLGQFWSESTQTESPWWNGSNDAPKDWFEPVEWKCFSHVCTQPIKYKPEWLNERGSAFVVTGARLDVKVHGLKSVLHLHLLFSKIPGCTIQRSRWDQHPAAEKTSFFSSISTTFSSTTKAGKKGPPVVVDSAVFMGGPPRPIQSPKLLKFVDTAELTKGPQDSPGHWVVTAARLELDRGKISLGVKFSLLNYAE

SEQ ID NO: 162 - protein, 265 aa, Tupidanthus calyptratus
MEEEGGKPIEVIAMESLGLGFDFASDFKLKFAKRCPDGAGDDGRLVVIDEANKRDVVFPGGGVIRGVPESIRCGKGDRIRFKSDVLKFNQMSELINQKSSVQGKVPSGYFNAMFDLSGSWFNDAADSNHLAFDGYFISLYYLHLIASPLVLRDKVKNSVPSHWNPASLSRFILTYGTHIIVGLAVGGQDVICVKQRPSSGIPPAELRGYLEDLGDCMFSDGRNPVLERKTRDGKQKVPEVFNRMLQSHTMQFSSITETSSKDVRL

SEQ ID NO: 163 - protein, 332 aa, Asparagus retrofractus
MEGSEEREPVEVRALRSLGLGFDLTNDFRLNFARRRGRRRLVELDEADTRDIVIPGNITIKDVPVDVGCDKGDRMRFRSDVLEFNQMSELLNQRSSIQGKVPSGYFNSLFDLSGAWLDDAKNTKHLAFDGYFISLYNLHLRSSPLVLRDEVKKAVPSKWEPALLSRFIQTYGTHIIVEMAVGGQDVICVKQSHSSTISSAELKLHLEDLGDILFSDERSLSPLHRKGKEGKSKAPDVFFKILQSNNLQLSSHSESSSKDGITVICSKRGGDAYLCNHSKWLQTVPITPDAILFKFVPITSLLTGVPGSGYLSHAINLYLRYKPDPEDLQHFC

SEQ ID NO: 164 - protein, 598 aa, Dryopteris filix-mas
MASGKDAAAVAAVEALGCGFDLTSDYRLKYRKGPLLHLQHSYTKDLAIPGGITIPDVSRDVKCDKGERIRFASEVMQFQQMSQWFNQNASVEGKIPLGLFNAMFDLSGSWQDDANQLKNLAFDGYFITLYKLHLARSNLVLREEVKNDIPSVWDPQSLAKFIEKYGTHIIVSASVGGQDVLYLKENYSSLLSTQDIHKKLKSAGDDYFSDRGGENSTNFKESETLPLNALSSQPFRATVAHIHSAQVLVTNKDFTIISQRRGGYHFAKTHCGWQETVNIFPEAISLSFVPITSLLVGVAGSGFLQHAINLYLRYKPPVSDIQYFLDFQVPRQWIPIHNELPLRLARKQTFSPSLQFSLTGPKLYINNNEVVVNRKPVTGIRLYLEGRKSNRLAIHLQHLSVLPQSLGQFWNEGTELESPQWNGSNDAPKEWFEPVEWKCFSHVCTQPIKYKPEWLNERGSAFVVTGARLEVKAHGLKNILHLHLLFSKIPGCTIQRSRWGQHPAAEKTGFFSSISTTFSSTTKAGKKGPPVVVDSAVFIGGPPRPIQSPKLLKFVDTTELTKGPQDAPGHWVVTAARLELDRGKISVSVKFSLLNYSE

SEQ ID NO: 165 - protein, 611 aa, Ophioglossum pendulum
MLGTKKGASHTRQAQNTALSAVHALGCGFDATSDFRLHGCKRTGPLVEVDKNFTQTLSVPGLFSIPNVSKDIKCDKGEFTRFASDVMDFQQMSELFNQNASIEGKVPLGFFNSSFDFSGSWQTDAKNSKNLAIYGSFITLYTLQLTRSPLILREEVKEAVPSTWEPAGLARFIEKYGTHIIISVSIGGQDVLYLKQNHSSSMTSSDVHSFLTKLGDQYFRDGSSQKNISKLNETNEKLAQYYASFSQPTHMQVAQLHSGRLLFGDKELTVTSKRRGGDLWATKHEEWQRAVKSSPDAISMSFIPITSLLSGVPGKGFLNHAINLYLRYKPPIEEIQYFLDFQVPRQWAPVYSELTLGPPRRQAALPSLRFSFMGPKLYINTAQVCTDKLPVTGVRLFLEGRRHNIFAIHLQHLSSLPQVLKPYWGEDVKVEPPRWHGTNDGDSKWFEPVKWRGFSHVCIKPVKFCSEWLESQGGVFIVTGAQLDKRKYGLKSVLHLKLQFTRLLDCTLQKSCWDQTTTSSQKSGFFSALSTTFIHQNKNSKDPKPVVLNSAVLSSAPPKPSQGPKLLKFVDTKESSKGPEDIPGHWLVTAAQLELDKRKICLRVKYSLITY

SEQ ID NO: 166 - protein, 407 aa, Platycerium bifurcatum
MASKLDIPNAAKVAHLAIQSLGRGYDLTCDLRFSSFKDRNGTSLIQLRNDETIKLSLPGGVIVADVPAIVKCDKGERTRFQSDILSFDQMCQQFNQGLSLSGKVPCGLFNNMFNFSGSWQKDASTTKHLALDGWFYTLYTVEMPRSKLVLKENIKSLVPTSWEPAALARFIETFGTHIIVGVKIGGKDVVYMRQHQSSPSTPIEFQKLLTEVSNERFLQTEGRASMGSKDSRSHKKRNIEFQSWSAHLDTFSQMIYNEKHHITIIPRRKGGFDHGQSHSEWIHTVPLTPDVISVSLIPITFLLHGVAGSGFLSHAVNLYLRYNPPIEELRQFLEFQLPRVWAPVYGELPLTLPRREPSLPTLQFSLMGPKLKVSKLEFNEHGILGSRYVHPFLPKLRMVTNRVSNSV

SEQ ID NO: 167 - protein, 354 aa, Tupidanthus calyptratus
MAFNANRFDPQSAAEKAVSAIGSGYDLTVDIRLSECKPGPSGSGLIELDRTLTKDLNLPCGRVVRNVSPSIKCGKGEQTRFHSDVLTFVQMSEQFNQDISLSGKIPSGLFNAMFDFKGCWQKDAATTKSLAFDGWFFSMYNIELARSQITLSEQVKKEVPSSWDPAALAEFIEKYGTHIVVGVKMGGKDVIHLKQLQNSNLQPTEVQKLLKQLADERFSEDVNGSLIPNPEKSSGKQKEEPSIVQDLNLPFANLLRQAVVSQSKNDDLLSIRIRRGGFDTGQSHKQWLSTVSQFPNAISMSFVPLASLLSGIRGSGFLSHAINLYLRCEYAYPSIVVLVSGLIFCGVRLLSREY

SEQ ID NO: 168 - protein, 523 aa, Waldsteinia ternata
MSELLNQKSSVQGKIPSGYLNSIFGLSGDWLQDAAETKYLAFDGFFISLYNLHLTASPLVLRNKVQKSVPSRWDPAALSRFIHSYGTHIIVGMAVGGQDLVCVRQKSSSPVPPADLRRNLEDLGDFLFSDGPSLLRGKTRNGKQKIPEVFDRILQSNTMQLTTISETSSKDGLTVVCSKRGGDVFLNSHSNWLQTVLAEPEAIIFKFVPITSLLTGLPGSGYLSHAINLYLRYKPDLEDLQHFLEFQVPRQWAPMFCELPLSHQRKKASCPSLQFSFMGPKILVSSMQVSTSQKPVVGLRLYLEGKKCNRLAVHVQHLSSLPNTMELKLANTRTTRPSWWRGSDDSEFSGQFLEPIKWKRYSSICSSVVRYDPNWLKGDPGGVYIVTGAQLLSKGKWPKTILHLRLHYTFLPSCAIRKTEWAGSPEPSHKSTFLMNLSTTFTMTQRTVTDQQKQDPAALNSGVYPEGPPVLNRSAKLLKFVDTAEVVRGPHDAPGHWLVIAAKLVKEGNRIGLHTKFALLDYW

SEQ ID NO: 169 - protein, 595 aa, Lygodium flexuosum
MGTTRESSALAVAQAAIEALGCGFDVTANYRLKYCKCPVVQLPQTLVEDMLIPGGITILNVPRDITCDKGEMVRFTSEVMEFQQMSQWFNKNSSIEGKIPLGYFNAMFDLSGSWPDDATQTKSLAFDGFFITLYKLQLSRINLVLREEVLSDIPSTWDPKSLAQFIEKYGTHVIVAVNIGGQDVLYLKENRSSSLSAKEIQQHLKLAGDSCFTDGGNNRTLVSKENEMYSLTSQASVAMHSAQLFITNKDVTIIGRRRGGNPLSKSHNEWQDTVSSSPDAISMSFVPITSLITGVSGSGFLQHAINLYLRYKPPIEDLRHFLDFQVPRQWIPEYSELPLGLLRMRGITPSLQFSLLGPRLYVNTTEVTVSRKPVTGIRLYLEGKRSNRLAIHLQHLSVLPRTLDQFWNEEIHIEQPKWHGSDGSDKKWFEPVQWKSFSHVCIEPIKFQPEWQNGKDGVFVVTGAKLEVKSYGLKSILHLRLLFTKIPGCMIQASRWDQPPASQKSNFFSSLTSTFSSTTKAVKRGSPAVLVDSAVYPGGPPKPVQSSKLLKFVDTTELTRGPQDIPGHWIVTAAKLELDCQKISLRVKYSLLNFM

SEQ ID NO: 170 - protein, 390 aa, Platycerium bifurcatum
MASKLDIPNAAKVAHLAIQSLGRGYDLTCDLRFSSFKDRNGTSLIQLRNDETIKLSLPGGVIVADVPAIVKCDKGERTRFQSDILSFDQMCQQFNQGLSLSGKVPCGLFNNMFNFSGSWQKDASTTKHLALDGWFYTLYTVEMPRSKLVLKENIKSLVPTSWEPAALARFIETFGTHIIVGVKIGGKDVVYMRQHQSSPSTPIEFQKLLTEVSNERFLQTEGRASMGSKDSRSHKKRNIEFQSWSAHLDTFSQMIYNEKHHITIIPRRKGGFDHGQSHSEWIHTVPLTPDVISVSLIPITFLLHGVAGSGFLSHAVNLYLRYNPPIEELRQFLEFQLPRVWAPVYGELPLTLPRREPSLPTLQFSLMGPKLKVSKLEKCVLCRWQLGKSL

SEQ ID NO: 171 - protein, 635 aa, Microsorum musifolium (Blume)
MASAAGGFAALQPQSSEAAPPQNTPFSVAQQAIDALGRGYDVNSDLWLRYCQHTERLIESTPGPTQDLLLPGNIVIPKVSASIKCDKGDRTRFTSDVLTFNEMSEQFNQNLALSGKIPVGHFNAMFGFTGSWQRDASAVKTLAMDGVFITLYSVELPRAQLTLKEEVKAAVPSSWDPAALASFLEKYGTHVIVGVKIGGKDVVCLKQHRSSSLSAVGVQKILEAKGKERFSSLEGSAAKEKINKGKIRDGSPFGSNGMNAVNGSKDLPWISDSSTDHMVETDDVTVIFKRKGGRDLSQSHDEWLHTVPLFPDIVSMSFVPITSLLNGITGTGFLNHAINHYLRYKPPIQELHHFLEFQLPKEWAPAFGDLPLGPPRKQAGSPSLQFRLMGPKLQVNTTPVVIGKRCVTGLRLHLEGKKSNRLAIHLQYLTVVPQILQQLWQDDQPEVWEGPDDDFSKYFEPVMWKSFSHVCTAPVESTETWEDEGKGGSGSKGAQVVTGAQLDVLQCGSKKVLFLKLLYSKIHKAKIRRFEWDHAPASQQKSGIFSTLMSTTFSSAQATPQKPVQVVVNSAIYPQGPPAANSQAPKLLKFVDTSEMTRGPLDLPGHWLVTGAKLFVDRGKIAVRAKYSLLLYSVD

SEQ ID NO: 172 - protein, 594 aa, Microsorum musifolium (Blume)
MASAKDTAALAAVEALGCGFDLISDYRLKYKKGPLLQLQHSQNKDLTIPGGITIPDISRDIKCDKGERMRFASEVMQFQQMSQWFNQNASIEGKIPLGLFNAMFDLSGSWQDDANRLKNLAFDGCFITLYKLHLTRSNLVLREEVKNDIPSVWDPKSLAKFIEKYGTHIIVSASVGGQDVLYLKENYSSLLSAQDIRKKLKSAGDEYFSEISGKKSVDFKDSETLPLNSQPFRGTIAASAQLLISNKDYTVISQRRGGYHFAKTHWEWQETVNVYPEAISLSFVPITSLLLGAAGSGFLQHAVNLYLRYKPPVSDLQYFLDFQVPRQWIPVHNELPLRLARKQTFSPSLQFSFMSRKLYINNSEVVVNRKPVTGIRLYLEGRKNNRLAIHLQHLSVLPQSLDQFWREGIQIGAPQWNGSNDAPNDWFEPVEWRCFSHVCTQPIKYKPEWSSDRGSAFVVTGARLDVKAYGLKSVLHLHLLFSKVPGCSIQRSRWDQHPAEEKTGFFSSISTTFSTTTTKAGKKGPPVVVDSAVFMGGPPRPIQSPKLLKYVDTAELVKGPQDAPGHWVVTGARLELDRGKIAIKVKFSLLNYAE

SEQ ID NO: 173 - protein, 266 aa, Tupidanthus calyptratus
MEGGEETVKPIGLRAMESLGLGFDFASDFRLKFAKRCPGAGGDDRLVVLDEASRRDVVFPGGGVIRGVPECIRCDKGDRIRFKSDVLKFNQMSELVNQKSSVQGKVPSGYFNAMFDLSGSWLNDAADANHLAFDGYFITLYCLHLTASPLVLRDKVKKSVPSHWNPASLSRFILTYGTHIIVGLAVGGQDVICVKQRPSSGIPPAELRGYLEDLGDCMFSDGRNPVLERKTRDGKQKVPEVFNRMLQSHTMQFSSITETSSKDVRL

SEQ ID NO: 174 - protein, 613 aa, Tupidanthus calyptratus
MAFNANRFDPQSAAEKAVSAIGSGYDLTVDIRLSECKPGPSGSGLIELDRTLTKDLNLPCGRVVRNVSPSIKCGKGEQTRFHSDVLTFVQMSEQFNQDISLSGKIPSGLFNAMFDFKGCWQKDAATTKSLAFDGWFFSMYNIELARSQITLSEQVKKEVPSSWDPAALAEFIEKYGTHIVVGVKMGGKDVIHLKQLQNSNLQPTEVQKLLKQLADERFSEDVNGSLIPNPEKSSGKQKEEPSIVQDLNLPFANLLRQAVVSQSKNDDLLSIRIRRGGFDTGQSHKQWLSTVSQFPNAISMSFVPLASLLSGIRGSGFLSHAINLYLRYKPPMEELEQFLEFQVPRQWAPVYGDLPLAPRRKKQASPSLKFTFMGPRLYVNTIRVDSENRPVTGIRLYLEGKKSDHLAIHLQHLSTPPKRLQLSDDLSYEPIDEPAEKGYLEAVKWSMFSHICTQPVQYNGARIDDSASIVTKAWFEVKGIGMKKVLFLRLGFSTVASAVIRRSEWDGPTMSTRKSGLMSMLISTRFSTGLTEKPELRKKLDLNSAIYPEGPPLPTRAPKMLSFVDTKETVRGPEVPPGYWVVTGAKLCVEGGRIRVKVKYSLLTIMSEDSLFI

SEQ ID NO: 175 - protein, 605 aa, Blechnum gibbum
MASKHDIPNAAKVANVAIQSLGRGYDLACDLRFSSCKDFHGTSLVELNNKETHELSLPGGVVVANVPTIVKCDKGERTHFRSDILTFDQMSQQFNQGLSLSGKVPCGLFNYMFNFTGSWPKDASTTRHLALDGWFYTLYTVEMPRSQLVLKEDIKASVPTSWEPAPLARFIETFGTHIIVGAKIGGKDVVYMKQHQSSPSTSVDFQKLLAEVSDERFSQTEGRASVGSKDSRSNKKRIVEFQSWSAHLDIYNEKHHVTIIPRRKGGFDHGQSHSEWIYTVPLAPDVISVSLVPITSLLNGIAGNGFLSHAVNLYLRYKPPIEELRQFLEFQLPREWAPIFSELPLSLSRRELSPSTLQFTLMGPKLKVSKLQVTVGKKPVTGMRLFLEGKRCDKLAIHLQHLSAIPKFLQSLWEDHPFAREATWQDPDDYSTKYFEPVQWKNFSHVCTAPVENTETWIGDHAGASVVVGAQLAVKSFGLRNVLYLRLLYSKIPEAKIRRSEWDHMPASTQKSGMFSNFFSTSFSSAPAAAPVKVPAVVINSGIYPEGPPKPIHDPKLLKFVDTTEMTKGPQDMPGHWLVTGAKLYLDKRKISLRVKYSLLTVSSD

SEQ ID NO: 176 - protein, 643 aa, Rumohra adiantiformis
MASTVGGLGAAMQPQSSQAALPRNIKPSSALSVAHQAVDALGRGYDVNSDLWLRYCNRTERLIENDNSGPTQDLLLPGNIAIPNVPTSIKCDKGDRMRFTSEILTFNEMSEQFNQNLSISGKIPVGHFNAMFGFSGSWQKDASLVKTLAMDGVFINLYSVELPRAQLTLKEKVRAAVPSSWDPAALASFVEKYGTHVIVGVKIGGKDVICLKQHRSSSLSAVGVQKLMESKAKERFSSVDGLAGKEKINKGKIRDGSPYGTIGMNAVSGLKDGMRLSLINDSSSDHSTVETDDVTVIFKRKGGRDVSQSHEEWLHTVASAPDIVSMSFVPITSLLSGVTGTGFLSHAINHYLRYKPPIQELHHFLEFQLPKEWAPAFGDLPLGPPRKQPGSPSLQFRLMGPKLQVNTTPVVIGKRCVTGLRLHLEGKKSNRLAVHLQYLTVVPQILQRLWEDDQPEEWEGPDDDFSKYFEPVMWKSFSHVCTAPVESNDTWEDEGGKDAPAALVVTGAQLDVEQYGSKKVLFLRLLYSKIHKARVRRSEWDHAPASQQKSGIFSTLMSTTFSSAQSAPQKPIQVVVNSAIYPDGPPPAKSQAPKLLKFVDTTEMTRGPLDLPGHWLVTGAKLFVDRGKIAVRAKYSLLLYSVD

SEQ ID NO: 177 - protein, 636 aa, Onoclea sensibilis
MSSAVGGLAAMQAQSSERASPQNMAFSVAQQAVEALGRGYDVNSDLWLRYCKRGEHLIENDNSGPTQDLLLPGNIIIPNVPTTIKCDKGDRTRFTSDVLTFNEMSEQFNQNLSISGKIPVGHFNAMFGFSGSWQKDASQVKTLAMDGVFINLYSVELPRAQLTLKEEVRAAVPSSWDPAALASFVEKYGTHVIVGVKIGGKDMICLKQHRSSSLSAVGVQKILETKSKERFSSAEGSAAKEKINKGKIRDGSTYESNGMNAVNGSKDGMPLSWMTDSSTDLETDDVTVIFKRKGGRDISQSHDEWLHTVPSAPDIVSMSFVPITSLLNGVTGTGFLSHAINHYLRYKPPIQELHHFLEFQLPKEWAPAFGDLPLGPARKQQGSPSLQFRLMGPKLQVNTTPVVIGKRCVTGLRLHLEGKKSNRLAVHLQYLTVVPQILQRLWEDDQPEEWEGPDEDFGKYFEPVMWKSFSHVCTAPVESNETWVDEAKGEPGPKGAQVVTGAQLDVEQHGSKKVLFLRLLYSKIHKATIRRSEWDHTPASQQKSGIFSTLMSTPFSAQAAPLKPAQVVVNSAIYPQGPPPAKNQAPKLLKFVDTTEMTRGPLDLPGHWLVTGAKLFVDRGKIAVRAKYSLLLYSVY

SEQ ID NO: 178 - protein, 368 aa, Lygodium flexuosum
MYSLTSQASVAMHSAQLFITNKDVTIIGRRRGGNPLSKSHNEWQDTVSSSPDAISMSFVPITSLITGVSGSGFLQHAINLYLRYKPPIEDLRHFLDFQVPRQWIPEYSELPLGLLRMRGITPSLQFSLLGPRLYVNTTEVTVSRKPVTGIRLYLEGKRSNRLAIHLQHLSVLPRTLDQFWNEEIHIEQPKWHGSDGSDKKWFEPVQWKSFSHVCIEPIKFQPEWQNGKDGVFVVTGAKLEVKSYGLKSILHLRLLFTKIPGCMIQASRWDQPPASQKSNFFSSLTSTFSSTTKAVKRGSPAVLVDSAVYPGGPPKPVQSSKLLKFVDTTELTRGPQDIPGHWIVTAAKLELDCQKISLRVKYSLLNFM

SEQ ID NO: 179 - protein, 384 aa, Tupidanthus calyptratus
MAFNANRFDPQSAAEKAVSAIGSGYDLTVDIRLSECKPGPSGSGLIELDRTLTKDLNLPCGRVVRNVSPSIKCGKGEQTRFHSDVLTFVQMSEQFNQDISLSGKIPSGLFNAMFDFKGCWQKDAATTKSLAFDGWFFSMYNIELARSQITLSEQVKKEVPSSWDPAALAEFIEKYGTHIVVGVKMGGKDVIHLKQLQNSNLQPTEVQKLLKQLADERFSEDVNGSLIPNPEKSSGKQKEEPSIVQDLNLPFANLLRQAVVSQSKNDDLLSIRIRRGGFDTGQSHKQWLSTVSQFPNAISMSFVPLASLLSGIRGSGFLSHAINLYLRYKPPMEELEQFLEFQVPRQWAPVYGDLPLAPRRKKQASPSLKFTFMGPRLYVNTIRV

SEQ ID NO: 180 - protein, 629 aa, Sphaeropteris cooperi
MAAIAATQQHALPPPTVAKKAVEALGCGYDVTSDLWLRYCKGDGCLIEGHDSGPTQNLVLPGNVVLPNVPAYVKCDKGDRTRFTSDVLTFNQMSEHFNQNLSITGKIPLGHFNTMFGFTGSWQKDASTVKNLALDGVFINLYSVELPRTQLSLKEEVRAAVPTSWDPAALASFVEKYGTHIVVGVKIGGKDVIYLKQHRSSSLPAVGIQKILETKANERFSSVEGSTSKEKINKGKIRDGSTLEANVNNNVNAYYGGLKDGESFPWINDSISQVCENEEVTVIFKRKGGLEPSQSHNEWLHTVPLAPDVTSMCFVPITSLLNGFAGTGFLSHAINLYLRYKPPIQELHHFLEFQLPKEWAPAFGDLPLGPPRKHEGSPSLQFRLMGPKLQVNTTPVVIGKRPVTGLRLHLEGKKSNRLAVHLQYLSVVPRILQPLWEEDHVGGQEKWTGPDDGFFRYFEPVMWKSFSHVCTAPVEAPVENNETLGEGAFVVTGAQLQVEQHDSRKVLFLRLLYSKIPKARIRRGEWDHTPASQQKSGIFSTLMSTTFSAAQTPPLKPVQVVINSAVYPEGPPAAKSQTPKLLRFVDTTEMTRGPLDLPGHWLVTGAKLFVDRGKISVRAKYSLLFYSTE

SEQ ID NO: 181 - protein, 610 aa, Tupidanthus calyptratus
MSSSTSTSSSSSSSGDGIVWRAINSLGKGFDLTSDFRLKYCKGNHPLVLLNQTHTKQLLVPGFGYFNHVSSDINCGKGERTRYQSDILDFNQMSEFMNQRSSVPGKIPSGLFNSMFGFESESWAKEAASTKCLGLDAYFISLFHLRINRYPLVLCDEVRNAVPSTWDPSALARFIEKYGTHIIVSLGIGGQDTVVVRQDKSSNLEASDLKKYLDQLGDQLFTGTCTFTPKQRNHKAPAAFNVFDHQSTLFDNFSSVKTKNGVNVICSKRGGDVSAHTHCEWLLTVPSMPDAIQFSFIPITSLLKGVPGNGFLTHAINLYLRYKPPLDDLQYFLDFQAYKIWGPVHSELTLGPATNRALGTPTLHFNLIGPKLYVNTTRVTTEKRPVTGMRLYLEGMKCNRLAIHLQHLSNTPQFLHNKVGDALLWRGSEQFADGYLQPIQWKKFSHISTAPVKYDPQWTTKKEVSFIVTGAQLHVKKHDSKSVLHLRLLYSKVSNSCIIQSNWMQCPSYLSQKTGFFSAISTSILLGASTEKEDVKKVVVDSSAYPNGPPVAVQTQRLLKFVDMSEICRGPSDSPGHWLVTGAKLELEKGKICLHVKFSLLNIFDKNREP

SEQ ID NO: 182 - protein, 597 aa, Asplenium australasicum
MASGKDAVVLAAVESLGCGFDLTSDYRLKYKKGPLLHLQHSNKKDLTIPGGITIPDVSRDIKCDKGERIRFTSEVMQFQQMSQWFNQNSSVEGKIPLGLFNAMFDLSGSWQDDASQIKNLAFDGFFITLYKLHLARSNLVLREEVKNDIPSVWDPKSLAKFIEKYGTHIIVSASVGGQDVLYLKENYSSPLSAQDVHKNLKSVGDDYFADRAQRSTNYKDSETLPLNALNSQTFRPTVAHINSAQVLHSCKDFTIISQRRGGYLFAKTHCGWQETVNMFPDAISLSFVPITSLLLGVAGSGFLQHAINLYLRYKPPVSDIQYFLDFQVPRQWIPVHNELPLRLTGRQPFSPSLQFSFMSPKLYVNNNEVVVDRKPLTGIRLYLEGRKSNRLAIHLQHLSVLPQSLGQLWSDSTKSEAHLWNSSADAPREWHEPVMWKCFSHVCTQPIKYKREWSTDHESVFIVTGARLEVKAHGLKSVLHLHLLFSKISGCTIQRSRWHQHQTAEKAGFFSTLSTTFSSTAKAGKKGPPAVVDSAVYIGGPPRPIESPKLLKYVDTAELTKGPQDAPGHWVVTAARLDLEGGKIMLSVKFSLLNYAE

SEQ ID NO: 183 - protein, 611 aa, Colysis wrightii (Ching)
MASKPGIPNAAKVARLALQSLGRGYDLTCDLRFSSFKDVNGASLIDLRDNQTIDLSLPGGVVIANVPAIINCDKGERTRFRSDILSFDQMSQQFNHGLSLSGKIPCGLFNNMFSFTGSWQKDASTTKHLALDGWFYTLYTMEMPRSQLDLKEDIKASVPSSWEPAALARFIETFGTHIIVGVKIGGKDVVYMKQHQSSPSTSIDFQKLLSEVSDERFLHTEGRTSVGSKDSRSNKKHNIEFQSWSAHLDTFSQNIYNDKKHHVTIMPRRKGGFDHGQGHSDWIHTVPLAPDVISVSLIPITFLLHGVAGSGFLSHAVNLYLRYNPPIEELRQFLEFQLPREWAPVYSELPLTLPRREPSLSTLQFSLLGPKLKVCKLEVAVGKKPVTGMRLFLEGKRCDKLAVHLQHLSAIPRFLQPLWEDHPFAKEVTWQDPDDYSTKYFEPVQWKNFSHVCTAPVENTETWIGDHAGASVVVGAQLAVKSFGLRNVLYLRLLYSKIPEAKIRRSEWDHMPALAQKSGMFSSFLSTTFSSTPALPKAPAVVINSGIYPEGPPKPVRDPKLLKFVDTTEMTKGPQDMPGHWLVTGAKLYLDKRKISLRVKYSLLTVSSDCP

SEQ ID NO: 184 - protein, 636 aa, Aglaomorpha (Roberts)
MASAAGGFAALQPQSSEAARPQYTPFSVAQQAVDALGRGYDVNSDLWLRYCQHTERLIDSNPGPTQDLLLPGNILIPKVSASIKCDKGDRTRFTSDVLTFNEMSEQFNQNLAMSGKIPVGHFNSMFGFSGSWQRDASAVKTLAMDGVFITLYSVELPRAQLTLKEEVKAAVPSSWDPAALASFLEKYGTHVIVGVKIGGKDVICLKQHRTSSMSAVGVQKILEAKGKERFSSIEGSAAKEKINKGKIRDGSPFGSNGMNAVNGSKDLPWMSDSSTEYSTVETDDVTVIFKRKGGRDLSQSHEEWLRTVPSFPDIVSMSFVPITSLLNGVTGTGFLNHAINHYLRYKPPIQELHHFLEFQLPKEWAPAFGDLPLGPPRKQAGSPSLQFRLMGPKLQVNTTPVVIGKRCVTGLRLHLEGKKSNRLAIHLQYLTVVPQILQQLWQDDQPEEWEGPDDDFSKYFEPVMWKSFSHVCTAPVESTETWEDEGKGGPGSKGAQVVTGAQLDVLHCGSKKVLFLKLLYSRIHKTKIRRSEWDHTSASQQKSGIFSTLMSTTFSSAQAAPQKPVQVVVNSAIYPQGPPAANSQAPKLLKFVDTSEMTRGPLDLPGHWLVTGAKLFVDRGKIAVRAKYSLLLYSVD

SEQ ID NO: 185 - protein, 304 aa, Asplenium prolongatum x Asplenium antiquum (Kurata)
MSSTAFSIAQQAVDALGRGYNVNFDVSLSYGKQGKRLIEIDESGPTQDLLLPGNIIIPNMPASIKCDKGERTRFTTEFLTFNEMSELFNQNLAISGKIPTGHFNTMFDFSGSWQKDASQVKTLALDGFFINLYTVELPRAQLTLKEEVRAAVPSSWDPAALASFVKKYGTHVIVGVKIGGKDVVCLKQHRTSQLSTVRVQKILEEKAKERFTSIAGGTSKEKINKGKIRDGFSYGSDVMNAVNGSKDGLSLSWMNDSLSDLLTVETADVKVMFKRKGGKDVSQSHEEWLHTVPAAPDIVSMSFV

SEQ ID NO: 186 - protein, 618 aa, Verbascum chaixii (Vill)
MAFNPHSSRMDAKAAAEKAVSVIGFGYDLTSDIRLSACKPGPSGSGLIELERSRTKDLVVPGNVVVSNVSGSIKCDKGERTRFSSDALQFNQMSEQFNQELSLSGKIPSGLFNTMFGFKDCWQNDVSTSKILAFDGWLISLYTIELERSQITLSDKVKQEVPSTWDPPALAEFIEKYGTHVIVGVKMGGKDAIHIKQLKNSNLQPTEVQKLLKQLADKEFSEDENGNPIADPDTSPGKSKVQQSMIWDLHIPFASTMRPSVVSHSKNDDLLSIHIRRGGLDSGQSHNKWLSTVSQYPNVISMSFVPIGSLLSGIRGSGFLSHAINLYVRYKPPLEELTQFLEYQLPRQWAPAYNDLPLGPCLRKKASPSLQFTLLGPKLYVNTIKVDTANRPVTGLRLYLEGKRSDHLAIHLQHLLSLPQSLHLSPDHNYEPCDDSIDRAYFEPVKWSIFSHICTAPVEYHGARFDDSASIVTKAWFEVKGVGIKKVLFLRLGFSNVSSAIIRRSEWAGPTSTSKKSGLISMLMSTPFSTALNNNNNQTDKLNKINLNSAVYPGGPPSPAKAPKMSHFVDMKEMVRGPEEPPGYWVVTGAKLCVEMGMVRIKVKYSLLTIFSDDSLFM

SEQ ID NO: 187 - protein, 393 aa, Vernonia noveboracensis
MSQKLVENAIDSLGKGFDLTSDFRLKYCKGKERLVLLNENRSKELLVPGFGSFKEVSPDIKCDKGDRVRFQSDILDFNQMSEFFNKKCSVPGKIPTGLFNSMFGFQSGSWATDAANTKSLGLDGYFIMLFNVHLDRYPLVLSDEVLNAVPSTWDPPALARFIEKYGTHVVVGLGIGGRDVILLKQSKSSKLDSSQLKKHLEDLGDQLFNGSCTFSPHQLKTKEHKNKTPSAFNTIFDPEPMLFNGFSSTTQKDGLTIMCSKRGGDLTSTTHCEWLLTVPSMPDAINFDFIPITSLLPGVPGKGFLSHAINLYLRYKPPIADLEYFLDFQAHKIWAPVHNDLSLGPTTNRAIRDTSLNFNLMGPKLYVNTTQVTITKKPVTGMRLYLEGMKSNR

SEQ ID NO: 188 - protein, 384 aa, Prostanthera rotundifolia
MASNGGSSRKEIAVRLRRAAEEAVECIGQGYDLTQDLRLKYCKKQQSRLIPVDDGKVRDIAIPGGILVQNVPQAINCDKGERMRFSSDVLSFQQMSEQFNQELSLSHKIPTGHFNAAFEFTGSWQKDAAFTKSLAFDGVFITLYSIALEKSQVTLQDHVKQAVPSSWDPAALARFIEKYGTHIIIGVKMGGKDVVYVKQHYSSPLQPIDVQQRLKDAADKRFSDANGQSSMHPEKSYGREMPVSNERGFAFSDPGTPSFHSNQEEFTFFWRRRGGGSDRNMPHTKWSQTVQIEPEVISMSFIPISSLLSGIDGSGFLGHAINLYLRYKPPIEELHQFLEFQLPKQWAPVFGNVPLGPDRKQQGAASLQFSLMGPKLYVNTEEVD

SEQ ID NO: 189 - protein, 558 aa, Tupidanthus calyptratus
MSSSTSTSSSSSSSGDGIVWRAINSLGKGFDLTSDFRLKYCKGNHPLVLLNQTHTKQLLVPGFGYFNHVSSDINCGKGERTRYQSDILDFNQMSEFMNQRSSVPGKIPSGLFNSMFGFESESWAKEAASTKCLGLDAYFISLFHLRINRYPLVLCDEVRNAVPSTWDPSALARFIEKYGTHIIVSLGIGGQDTVVVRQDKSSNLEASDLKKYLDQLGDQLFTGTCTFTPKQRNHKAPAAFNVFDHQSTLFDNFSSVKTKNGVNVICSKRGGDVSAHTHCEWLLTVPSMPDAIQFSFIPITSLLKGVPGNGFLTHAINLYLRYKPPLDDLQYFLDFQAYKIWGPVHSELTLGPATNRALGTPTLHFNLIGPKLYVNTTRVTTEKRPVTGMRLYLEGMKCNRLAIHLQHLSNTPQFLHNKVGDALLWRGSEQFADGYLQPIQWKKFSHISTAPVKYDPKWSSKKDVTFIVTGAQIHVKKLNSMSALHLRLLYSKVSGSCIDQSNWMQCQSDLSQKSGFFSALSSSILLGHCTVKLDAVPIRSFPKVRIVFSSKFIDIIWW

SEQ ID NO: 190 - protein, 546 aa, Asparagus retrofractus
MEGSEEREPVEVRALRSLGLGFDLTNDFRLNFARRRGRRRLVELDEADTRDIVIPGNITIKDVPVDVGCDKGDRMRFRSDVLEFNQMSELLNQRSSIQGKVPSGYFNSLFDLSGAWLDDAKNTKHLAFDGYFISLYNLHLRSSPLVLRDEVKKAVPSKWEPALLSRFIQTYGTHIIVEMAVGGQDVICVKQSHSSTISSAELKLHLEDLGDILFSDERSLSPLHRKGKEGKSKAPDVFFKILQSNNLQLSSHSESSSKDINPILRICSIFAKPSIRQWAPMFNDFTLGPQRRKAFYPSLQFRFLGPVLRVNTTQVTSNQKPVVGLRLFLEGSKCNRLAIHLQHLSSLPSMFTTSTSSMSQWKGSEESGSGFLEPIQWKKYASICTCPVKYDPEWLEKASLDGVFVVTGAQLITKGNWPKKSLHIRLLFTHIPNCSILRTEWARTPASTSHKGSFLTNISTTFTQRDNATHKHEPSVILNSGVYPDGPPVPIQSRKLLKFVDMAEVVKGPQDIPGHWLVIGARLVKESGKIGLHVKFALLNYSESQG

SEQ ID NO: 191 - protein, 630 aa, Lygodium japonicum
MFYTSSSSSAPSDPASVAKQAVDALGRGYDVTGDLWLSKCREPLIVDLAESSPTQDLAIPGGISLPCVPAPIKCDKGDRTRFASDILSFSEMSEQFNKTLSIAGKIPLGLFNSMFGFTGLWQKDASSTKTLGLDGVFINLYSVEVPRTHLTLREEVRKAVPSSWDPAALASFVEKYGTHVIVGVKIGGKDVVYIKQRHSSTLSGVSIQKILETKALERFSSGETCTSKEKLTKGKDFQTKGIHGAEPNGQNGNLLRGHVDGIENSESFSLMEDSSTFSVDGDVTVIYKRKGGRESCQSHNDWLHTVPLAPDVVSMSFVPITTLLNGVPGTGFLSHAINLYLRYKPPLQELSNFLEFQLPKEWAPAFGDLPLGPPRKQQEVPSLQFRLMGPKLHINTTPVVVGKRPVTGLRLYLEGKKSNRLAIHLQYLTAVPQILKTLWVEDGGGEEEWVGPEEDFSKYLEPVQWRNFSHVCTAPVENSETWLGGPGGALVVVGARLQVQQYGAKKVLFLHLLYSRIAKARIRRSEWDHMPASQQKSGLFSTLISTTFSSAAAQSPAPPKPVVINSAIYPEGPPVPGQMPKLLKFVDTTEMTRGPHDLPGHWLVTGAKLLLERGKISLRAKYSLLLYSVE

SEQ ID NO: 192 - protein, 389 aa, Celosia argentea (Sylphid)
MALKLSAAKAAEVAIGSIGRGYDISADLRLKFCKGDTLDSHLIEIDEDHCQEIALPGGISIPNVPTSIKCDKGERTRFRSDVLSFQQMSEQFNQEISLTGKIPSGLFNTMFEFSGCWQKDAAYTKTLAFDGVFITLYTVALEKSQLVLRDHVKQAVPSSWEPAALARFIEKFGTHIIVGIKMGGKDVVFVKQQHSSSLQPAEVQKKLKEIADKRFLEANGQSEFNAGHIYQDGKFDAREQRLRFADLSPSCSYSHKEDIVTICKRRGGSDIKNLPHHEWLQTVQSEPDVISMSFIPITSLLNGVPGSGFLSHAINLYLRYKPPLEELHQFLEFQLPRQWAPVFSELPLGPQRRQQNYASLQFSFMGPKLYVNTIPVLFLECFYFYFCVT

SEQ ID NO: 193 - protein, 391 aa, Sphaeropteris cooperi
MMSSADVHKHLKNLGDQMFAEKGVQKIQDGNSLRGCSIAPVEIDGTNILYKSKDLTIIAKKRGGRLCAKTPSEWQATVMSAPDVIMMSFVPITALLSGTPGSGFLNHAINLYLRYKPPIEDIRCFLEFQVPRQWAPVYSDLPLGPPQRAITLPSLQFCLMGPRLYVNTAQISVGRKPVTGLRLYLEGRQNNRLAIHLQHLASLPRVLEPYWNPEIHEQSNWHGSDNVESSEWFEHVQCRTFSHVCTARVKYNPVWTRSKSGVFVVTGAQLEVKSYGLKNVLHLRLQFSRIPGCTILKSRWYQPCSSNLSEKSRFFSTLSTAFTSHMVKKPVQPSPVVVDSGVFLGEPPIPIQQPKLLRFVDTRELTKGPQDMPGHWLVIGAQLDVDGARSL

SEQ ID NO: 194 - protein, 593 aa, Platycerium bifurcatum
MASAKEAAALAAVEALGCGFDLTSDYRLKYKKGSLLELQHSHNKDLTIPGCITIPDVSRGIKCDKGEHMRFTSEVMQFQQMSQWFNQNASVEGKIPLGLFNAMFDLSGSWQDDANRLKNLAFDGCFITLYKLHLTRSNLVLREEVKNDIPSVWDPKSLAKFIEKYGTHIIVSASVGGQDVLYLKENYSSLISAQEIRKKLKSAGDEYFSETSGKRNADFKHSETSPLNSQPFRGTIAGSAQLLISNKDYTLISQRRGGYYFAKTHCEWQETVNMYPEAISLSFIPITSLLLGAVGSGFLQHAINLYLRYKPPVSDLQYFLDYQVPRQWIPVHNELPLRLARKQAFSPSLQFSLMSPKLYIDNNEVVVSRKPVTGIRLYLEGRKNNRLAIHLQHLSVLPQSLGKFWSEGIQIEAPLWNGSSDAPNEWFEPVEWKCFSHVCTQPIKYKPEWSNEQGSAFVVTGAQLGVKAHGLKSVLHLHLLFSKIPGCSIQRSRWDQHPAAEKTGFFSSISTTFSTTTKAGKKGPPVVVDSAVYMGGPPRPIQSPKLLKFVDTAELTKGPQDAPGHWVVTAARLELDRGKIAIKVKFSLLNYAE

SEQ ID NO: 195 - protein, 603 aa, Platycerium bifurcatum
MASKLDIPNAAKVAHLAIQSLGRGYDLTCDLRFSSFKDRNGTSLIQLRNDETIKLSLPGGVIVADVPAIVKCDKGERTRFQSDILSFDQMCQQFNQGLSLSGKVPCGLFNNMFNFSGSWQKDASTTKHLALDGWFYTLYTVEMPRSKLVLKENIKSLVPTSWEPAALARFIETFGTHIIVGVKIGGKDVVYMRQHQSSPSTPIEFQKLLTEVSNERFLQTEGRASMGSKDSRSHKKRNIEFQSWSAHLDTFSQMIYNEKHHITIIPRRKGGFDHGQSHSEWIHTVPLTPDVISVSLIPITFLLHGVAGSGFLSHAVNLYLRYNPPIEELRQFLEFQLPRVWAPVYGELPLTLPRREPSLPTLQFSFMGPKLKVAVGKKPVTGLRLFLEGKRCNKLAIHLQHLSAIPKFLQPLWENHPFAREVTWQDPDDYSTKYFEPVQWKNFSHVCTAPVENTETWIGDHAGASVVVGAQLAVKSFGLRNVLYLRLLYSKIPEAKIRRSEWDHMPALTQKSGMFSSFLSTTFSSTPAPPKVPAVVINSGIYSEGPPNPVRDPKLLKFVDTTEMTKGPQDMPGHWLVTGAKLYLDKRKISLRVKYSLLTVNSD

SEQ ID NO: 196 - protein, 519 aa, Vernonia noveboracensis
MSEQFNQEISLTGKIPSGLFNAMFEYSGSWQKDASSTKTLAFDGVFISLYTVALEKSQMVLCDNVKKAVPSSWDPALLARFIEKFGTHIIVGVKMGGKDVIYMKQQHASSLQPADVQKRLKAMADKRFLDADGQYIIDAEHTSHNDKDDIRGQRLRFADADPSSSYSYKEDLVSIYKRRGGCDDRNLKHNEWLHGVQLEPDVITMSFIPITSLLNGVSGSGYLSHAINLYLRYKPPVEELHQFLEFQLPRQWAPVFSDLPLGPQRKQQTTPSLQFSFFGPKLYVNINPVDVGKRPVTGLRLYLEGKRSNRLAIHLQHLSSLPKVFQLEDDVDGNLAEESYDRRYYEKVQWKHFSHVCTAPVESDDELSIVTGAHLHVGDYGFKRILFLRLRFSTVVGAAAIKNPEWDGSPGLARKSGLISTLISHHFTAVLKSQPQAAEVNINSAIYPGGPPAPVQVPKLLKFVDTAEMTRGPQESPGYWVVSGARLVVDKGKISLRVKYSLLTVISADEEEEAAAAFY

SEQ ID NO: 197 - protein, 295 aa, Sphaeropteris cooperi
MMSSADVHKHLKNLGDQMFAEKGVQKIQDGNSLRGCSIAPVEIDGTNILYKSKDLTIIAKKRGGRLCAKTPSEWQATVMSAPDVIMMSFVPITALLSGTPGSGFLNHAINLYLRYKPPIEDIRCFLEFQVPRQWAPVYSDLPLGPPQRAITLPSLQFCLMGPRLYVNTAQISVGRKPVTGLRLYLEGRKNNRLAIHLQHLSSLPRVLEPHWNAEVAHEQSNWHGSDNVGSSEWFEHVQCRSFSHVSTARVKYNPEWARGKTGVFVVTGAQLDVKNYGLKNVLQHSSRQVQSCVDT

SEQ ID NO: 198 - protein, 624 aa, Tupidanthus calyptratus
MAFNANRFDPQSAAEKAVSAIGSGYDLTVDIRLSECKPGPSGSGLIELDRTLTKDLNLPCGRVVRNVSPSIKCGKGEQTRFHSDVLTFVQMSEQFNQDISLSGKIPSGLFNAMFDFKGCWQKDAATTKSLAFDGWFFSMYNIELARSQITLSEQVKKEVPSSWDPAALAEFIEKYGTHIVVGVKMGGKDVIHLKQLQNSNLQPTEVQKLLKQLADERFSEDVNGSLIPNPEKSSGKQKEEPSIVQDLNLPFANLLRQAVVSQSKNDDLLSIRSFDTSQSHKQWLSTVTQFPNAISMSFVPLASLLSGIRGSGFLSHAINLYLRYKPPMEELEQFLEFQDKPPMEELEQFLEFQVPRQWAPVYGDLPLAPRRKKQASPSLKFTFMGPRLYVNTIRVDSENRPVTGIRLYLEGKKSDHLAIHLQHLSTPPKRLQLSDDLSYEPIDEPAEKGYLEAVKWSMFSHICTQPVQYNGARIDDSASIVTKAWFEVKGIGMKKVLFLRLGFSTVASAVIRRSEWDGPTMSTRKSGLMSMLISTRFSTGLTEKPELRKKLDLNSAIYPEGPPLPTRAPKMLSFVDTKETVRGPEVPPGYWVVTGAKLCVEGGRIRVKVKYSLLTIMSEDSLFI

SEQ ID NO: 199 - protein, 609 aa, Onoclea sensibilis
MASKHDIPNAAKVANIAIQSLGRGYDLICDLRFSSCKDVHGAPLIDLSNKETHKLSLPGGVVVANVPTIVKCDKGERTHFRSDILTFDQMSQQFNQGLSLSGKVPCGLFNYMFNFTGSWQKDASTTRHLALDGWFYTLYTVEIPRSQLVLKEDIKASVPTSWEPAALARFIETFGTHIIVGAKIGGKDVVYMKQHQSSPSTSIDFQKLLAEVSDERFLQTESRASVGSKDSRSNKKHSVEFQSWSAHLDTFSQIIYNEKHHVTIIPRRKGGFDHGQSHSEWIHTVPLAPDVISVSLVPITLLLNGVAGSGFLSHAVNLYLRYKPHIEELRQFLEFQLPREWAPVFSELPLTLSRREHSPSTLQFTLMGPKLKVSKLQVTVGKKPVTGMRLFLEGKRCNKLAIHLQHLSAIPKFLQSLWEDHPFAREATWQDPDDYSTKYFEPVQWKNFSHVCTAPVENTETWMGDHAGASIVVGAQLAVKSFGLRNVLYLRLLYSKIPEAKIRRSEWDHMPASTQKSGMFSNFLSTTFSSAPAAPAKVPVVVINSGIYPEGPPKPVHDPKLLKFVDTTEMTKGPQDMPGHWVVTGAKLYLDKKKIALRVKYSLLTVSSD

SEQ ID NO: 200 - protein, 509 aa, Tupidanthus calyptratus
MSEQFNQEMSLTGKIPSGVFNTMFEFTGSWQKDAANTKTLAFDGVFITLYTVALEKTQMILSDHVKQAVPSSWDPAALARFIEKFGTHIIVGVKMGGKDVIYMKQQHSSSLQPSDVQKRLKTIADKRFVDASGQYGMDSEQTHQNDKFQIREQRLRFADTSPSSSYSYKEDIVIICKRRGGSDNKNLTHNEWLHNVQLEPDVISMSFIPITSLLNGVSGSGFLSHAINLYLRYKPPVEELHQFLEFQLPRQWAPVFSDLPLGPQRRQQSTSSLQFSLMGPKLYVNTTPVDVGKRPVTGLRLYLEGKRSNRLAMHMQHLSSLPKVFQLKDDPNGNFRQESYDHRYYEKVQWKNFSHICTAPVESDEDLSIVTGAQLEVGDYGFKRVLFLRLRFSTVLGAVAVKHPEWDGSPGLARKSGLISTLISHHFTATLKPPPQPADVNINSAIYPGGPPAPTQSAKLLKFVDTTEMTRGPQETPGYWVVSGARLMVEKGRISLKRVGFHFGSSTRY

SEQ ID NO: 201 - protein, 353 aa, Platycerium wandae
MASKLDIPNAAKVAHLAIQSLGRGYDLTCDLRFSSFKDRNGTSLIQLRNDETIKLSLPGGVIVADVPAIVKCDKGERTRFQSDILSFDQMCQQFNQGLSLSGKVPCGLFNNMFNFSGSWQKDASTTKHLALDGWFYTLYTVEMPRSKLVLKENIKSLVPTSWEPAALARFIETFGTHIIVGVKIGGKDVVYMRQHQSSPSTPIEFQKLLTEVSNERFLQTEGRASMGSKDSRSHKKRNIEFQSWSAHLDTFSQMIYNEKHHITIIPRRKGGFDHGQSHSEWIHTVPLTPDVISVSLIPITFLLHGVAGSGFLSHAVNLYLRFFLQIIHLLKSCASFWSFSSPVYGPQFMVNCL

SEQ ID NO: 202 - protein, 339 aa, Phormium (Lancer Terra Cotta)
MRPTDLMTPEAAAAAAVSAVGYGYDLVGDLRLSSCKAGPSGSRLIKIDDALVHDLVLPGGVVVPNVPKEIRCDKGERTRFRSDVLGFHQMAEQFNQDLSLSGKIPSGLFNAMFDFRGCWQKDLSSTKSLAFDGWFITLYSIELAKSHIVLQDKIKQEIPSSWDPVALAEFIEKYGTHIIVGIKMGGKDAVSIKQLQESALQQTEVQNLLKNLADDAFSEDFNANILLGAAEISKRLKGIKLANQENNAAVLKSMNSSIVTHLKKDDIVSIHVRRGGINTKQSHNQWLSTISQAPNVISMSFVPITSLLTGVRGSGFLSHAVNLYLRCQQQSETQNRASS

SEQ ID NO: 203 - protein, 676 aa, Lygodium japonicum
MKPAAATIRPNFFTSSSSSAPSDPASVAKQAVDALGRGYDVTGDLWLSKCREPLIVDLAESSPTQDLAIPGGISLPCVPAPIKCDKGDRTRFASDILSFSEMSEQFNKTLSIAGKIPLGLFNSMFGFTGLWQKDASSTKTLGLDGVFINLYSVEVPRTHLTLREEVRKAVPSSWDPAALASFVEKYGTHVIVGVKIGGKDVVYIKQRHSSTLSGVSIQKILETKALERFSSGETCTSKEKLTKGKSTLSAVSIQKILETKALERFSSGETCTSKEKLTKGKDFQTKGIHGAEPNGQNGNLLRGHVDGIENSESFSLMEDSSTFSVDGDVTVIYKRKGGRESCQSHNDWLHTVPLAPDVVSMSFVPITTLLNGVPGTGFLSHAINLYLRYKPPLQELSNFLEFQLPKEWAPAFGDLPLGPPRKQQEVPSLQFRLMGPKLHINTTPVVVGKRPVTGLRLYLEGKKSNRLAIHLQYLTAVPQILKTLWVEDGGGEEEWVGPEEDFSKYLEPVQWRNFSHVCTAPVENSETWLGGPGGALVVVGARLQVQQYGAKKVLFLHLLYSRIAKARIRRSEWDHMPASQQKSGLFSTLISTTFSSAAAQSPAPPKPVVINSAIYPEGPPVPGQMPKLLKFVDTTEMTRGPHDLPGHWLVTGAKLLLERGKISLRAKYSLLLYSVE

SEQ ID NO: 204 - protein, 585 aa, Sphaeropteris cooperi
MGSESIARKVALEAVQSLGRGFDVTADFRTKFCKQRLVDVVNDGFVSLRLPGSIIIDAPSVVTCDKGDCIRHTTDLMQFQQVYLQIWNTHCHFNAMYDFTGSWFEDAMQTKNLAFDGKFITLFQLQLTSSLLLRKEVKNAVPSAWEPAALARFISLYGTHIVVRVSVGGQDVLYLKENASSMMSSADVHKHLKNLGDQMFAEKGVQKIQDGNSLRGCSIAPVEIDGTNILYKSKDLTIIAKKRGGRLCAKTPSEWQATVMSAPDVIMMSFVPITALLSGTPGSGFLNHAINLYLRYKPPIEDIRCFLEFQVPRQWAPVYSDLPLGPPQRAITLPSLQFCLMGPRLYVNTAQISVGRKPVTGLRLYLEGRQNNRLAIHLQHLASLPRVLEPYWNPEIHEQSNWHGSDNVESSEWFEHVQCRTFSHVCTARVKYNPVWTRSKSGVFVVTGAQLEVKSYGLKNVLHLRLQFSRIPGCTILKSRWYQPCSSNLSEKSRFFSTLSTAFTSHMVKKPVQPSPVVVDSGVFLGEPPIPIQQPKLLRFVDTRELTKGPQDMPGHWLVIGAQLDVDGGKISLNAKYSLLNFDFK

SEQ ID NO: 205 - protein, 323 aa, Tupidanthus calyptratus
MALKLPAPEAAKIAIQSIGCGYDICLDLRLKYRKRDSTNLSLIEIHEDQEKEIVLPGGILIPNVSKAIKCDKGEHARFRSDVLSFQQMSEQFNQEMSLTGKIPSGVFNTMFEFTGSWQKDAAHTKTLAFDGLFITLYTVALDKSQMVLSDHVKKAVPSSWDPAALARFIEKFGTHIIVGVKMGGKDVIYMKQQHSSSLQPSDVQKRLKTIADKRFVDARGQSGMDSEQTYQKDKFQVREQRLRFADTSLSRFADTSLSSSYSYKEDIVSICMRRGGNDNKNLTHNEWLHNVQLEPDAISMSFIPEWCLREWIPEPCHKSLLTL

SEQ ID NO: 206 - protein, 605 aa, Tupidanthus calyptratus
MAFNANRFDPQSAAEKAVSAIGSGYDLTVDIRLSECKPGPSGSGLIELDRTLTKDLNLPCGRVVRNVSPSIKCGKGEQTRFHSDVLTFVQMSEQFNQDISLSGKIPSGLFNAMFDFKGCWQKDAATTKSLAFDGWFFSMYNIELARSQITLSEQVKKEVPSSWDPAALAEFIEKYGTHIVVGVKMGGKDVIHLKQLQNSNLQPTEVQKLLKQLADERFSEDVNGSLIPNPEKSSGKQKEEPSIVQDLNLPFANLLRQAVVSQSKNDDLLSIRIRRGGFDTGQSHKQWLSTVSQFPNAISMSFVPLASLLSGIRGSGFLSHAINLYLRYKPPMEELEQFLEFQVPRQWAPVYGDLPLAPRRKKQASPSLKFTFMGPRLYVNTIRVDSENRPVTGIRLYLEGKKSDHLAIHLQHLSTPPKRLQLSDDLSYEPIDEPAEKGYLEAVKWSMFSHICTQPVQYNGARIDDSASIVTKAWFEVKGIGMKKVLFLRLGFSTVASAVIRRSEWDGPTMSTRKSGLMSMLISTRFSTGLTEKPELRKKLDLNSAIYPGGPPLPTKAPKMSSFVDTKEMVRGPEDPPGYWMVTGRAHPCQQEPQKCCLLWIRKKR

SEQ ID NO: 207 - protein, 596 aa, Symphoricarpos x chenaultii (Hancock)
MSDAIVRKALSSLGKGFDLTSDFRLKYCKGDDRLVVLNETNTTDLHVPGFGAFNGVSVDIKCDKGDRTRYQSDILDFNQMSEFFNQKSSVPGKIPSGLFNAMFGFESGSWAMDAGKTKHLGLDGYFIIMANVHIDRYPLVLSDEVRNAVPSNWDPSALARFIEKYGTHVIVGLSIGGQDVLLVRQDKSSNMEPSQLKNHLDNLGDQLFTGTCTFSPNIYLKTKDYKHKTPPAFNIFDPQPLPFNNSTSITAKDGINVISSKRGGDLSANTHCEWLLTVPSRPDAINFGFIPITSLLKGVPGKGFLSHAINLYLRYKPPIGDLQYFLDFQAHKIWAPVHNDLSLGPTTNRAIPTPALHFKFIGPTLYVNTTQVTVGRRPITGMRLYLEGMRCNRLAVHLQHLSNTPVLLQNKIDDAQKWRGSEEVADERYYEPIQWKKFSHICTAQVKYDPNWSTKKDVTFIVTGAQLHVKKHDSKTVLHLRLLYSKVSGSCIVQSNWMQSSSENSQKSGFFSAISMSMAGSSERDKTPAVVVDSSVYPTGPPVPVQSQKLLKFVDMSQLCRGPLDSPGHWLATGAKLDLEKGKICLRVKFSLLNIC

SEQ ID NO: 208 - protein, 621 aa, Blechnum gibbum
MASGKDAAALAAVEALGCGFDLTSDYRLKYRKGPLLHLQHSSNKDLAIPGGITIPDVSRDVKCDKGERIRFASEVMQFQQMSQWFNQNASVEGKIPLGLFNAMFDLSGSWQDDAKQLKNLAFDGYFITLYKLHLTRSNLVLREEIKNDIPSVWDPLSLAKFIEKYGVKNDIPSVWDPLSLAKFIEKYGTHVIVSASVGGQDVLYLKENYSSLLSAQDIHKQLKSVGDGYFSDRGGEKSGNFKDNETLPLNALNSQPFRATVAHLHSAQVLVTNKDFTIISQRRGGYHFAKTHCGWQETVNIFPEAISLSFVPITSLISGFAGSGFLQHAINLYLRYKPPVSDIQYFLDFQVPRQWIPIHNELPLRLARKQTFSPSLQFSLTSPKLYINNNEVVVNRKPVTGIRLYLEGRKSNRLAIHIQHLSVLPQSLGQFWNEGTQLESPRWNGSNDAPKEWFEPVEWKCFSHVCTQPIKYKPEWLHDRDSAFVVTGARLEVKVHGLKSVLHLHLLFSKIPGCTIQRSRWDEHPAAEKTGFFSSISTTFSSTTKAGGKKGPPVLVDSAVFVGGPPRPIQCPKLLKYVDTAELTKGPQDAPGHWVVTAARLDLDGGKISLRVKFSLLNYAE

SEQ ID NO: 209 - protein, 593 aa, Platycerium wandae
MASAKEAAALAAVEALGCGFDLTSDYRLKYKKGSLLELQHSHNKDLTIPGCITIPDVSRGIKCDKGEHMRFTSEVMQFQQMSQWFNQNASVEGKIPLGLFNAMFDLSGSWQDDANRLKNLAFDGCFITLYKLHLTRSNLVLREEVKNDIPSVWDPKSLAKFIEKYGTHIIVSASVGGQDVLYLKENYSSLISAQEIRKKLKSAGDEYFSETSGKRNADFKHSETSPLNSQPFRGTIAGSAQLLISNKDYTLISQRRGGYYFAKTHCEWQETVNMYPEAISLSFIPITSLLLGAVGSGFLQHAINLYLRYKPPVSDLQYFLDYQVPRQWIPVHNELPLRLARKQAFSPSLQFSLMSPKLYIDNNEVVVSRKPVTGIRLYLEGRKNNRLAIHLQHLSVLPQSLGKFWSEGIQIEAPLWNGSSDAPNEWFEPVEWKCFSHVCTQPIKYKPEWSNEQGSAFVVTGAQLGVKAHGLKSVLHLHLLFSKIPGCSIQRSRWDQHPAAEKTGFFSSISTTFSTTTKAGKKGPPVVVDSAVYMGGPPRPIQSPKLLKFVDTAELTKGPQDAPGHWVVTAARLELDKGKIAIKVKFSLLNYAE

SEQ ID NO: 210 - protein, 389 aa, Waldsteinia ternata
MRMEEATTEKPIEVRALEALGQGFDLSSDFRLKFAKGLDGSKGRLVVLNEESKRDIVIPSGSGGGVVIHGVPQDIHCDKGDRIRFKSDVLEFNQMSELLNQKSSVQGKIPSGYLNSIFGLSGDWLQDAAETKYLAFDGFFISLYNLHLTASPLVLRNKVQKSVPSRWDPAALSRFIHSYGTHIIVGMAVGGQDLVCVRQKSSSPVPPADLRRNLEDLGDFLFSDGPSLLRGKTRNGKQKIPEVFDRILQSNTMQLTTISETSSKDGLTVVCSKRGGDVFLNSHSNWLQTVLAEPEAIIFKFVPITSLLTGLPGSGYLSHAINLYLRYKPDLEDLQHFLEFQVPRQWAPMFCELPLSHQRKKASCPSLQFSFMGPKILVSSMQVHLSHSV

SEQ ID NO: 211 - protein, 251 aa, Matteuccia struthiopteris
MGGFTHCIQWKCQSQLVLKEDILASVPTSWEPAALARFIETFGTHIIVGAKIGGKDVVYMKQHQSSPSTSIDFQKLLAEVSDERFLQTESRASVGSKDSRSNKKRSVEFQSWSAHLDTFSQIIYNEKHHVTIIPRRKGGFDHGQSHSEWIHTVPLDPDVISVSLVPITVLLNGVSGSGFLSHAVNLYLRYKPHIEELRQFLEFQLPREWAPVFSELPLTLSRREHSPSTLQFTLMGPKLKVNKLQKCLLCR

SEQ ID NO: 212 - protein, 439 aa, Waldsteinia ternata
MLVKQDKSSDLGPSELKKHLNELGDQHFTGTCSFSPLHSKTKDHKHRLTPQAFNVFDAPQSVAINGFSTAHTKDGITVISSKKGGDPSASSHSEWLLTVPSRPDAIHFSFIPITSLLKGVPGKGFLSQAINLYLRYKPPIADLPYFLEFQVSHKIWAPMHNDLRLGPATNSKSNPSSPAIYFSLMGPKLYVNTTQVKVGNCAPVTGMRLFLEGMKCNRLAIHLQHLANTPLMLENKIDDTSSWRGSEEVTDHGYFEAINGNKFSHVCTAPVLYDLEWTSPSSINSAFIVSGAQLVVKQHGSKSVLHLRLLFSKVLDYFIVQSVWGESSCSSSRSSPSSSSSSSSGLLDAISRPVSGGYWAKEKVEPAGEQVILDSSVFPAGPPVPLPSQKFVKYVNTSHVCKGPQNSPGHWLVTGARLNLVQGKIGLQVEFSLLNAVEY

SEQ ID NO: 213 - protein, 601 aa, Equisetum
MMAQTRAKEAIHALGRGYDAVNDLRLSHCKENLGARLIELDELHMQDLVIPGGITVRGVPKSVTCEKGERTRFKSDVLPFQQMSEQVNQWMSISGKIPLGLFNGMFGFSGHWQKDALSVKDLAIDGWLITLYSVELPKSQLVLREDVKKDVPSSWDSSALASFIEKYGTHIVVGVKIGGKDVLCVKQHQSSGVSAVEIQALLKRKADERFRKRESDSTINSEQKSDIEQNLLSNQSNPFPFCGATTTIFSSQEDATVLCNRRGGIDTGQSHDEWLQTVPGAPDAILMSLVPITSLLNGVSGSGFLSHAVNLYLRHKPPIEELTQFLEFQLPRQWAPVFSELPLGPPRKERSTSSLQFSLIGPKLRVNTAPVNVGKRPVTGLRLYLEGRKCNRLAIHIQHLSVVPRVLQPLWEDTEPRWQHGEGNEELDQRYLEPVSWRSFSHVCTAPVENTEGWTSEDENQCAYVVVGARLGVKGVGMKNVLFLDLLYSKILHTKIRRSEWDHTPTSSQRSGFFSTLMSGTFANMQRAAPVRPPLVNLNSGIFPGGPPNPSRVPKLLKFVDTTELTKGPQDMPGHWLITGARLYLERGKISLRAKYSLLIY

SEQ ID NO: 214 - protein, 601 aa, Aglaomorpha (Roberts)
MASKLDIPNAATVAHLAIQSLGRGYDLTCDLRFSSFKDVNGASLIELRDSETIELSLPGGVVVANVPAIVKCDKGERTRFRSDILAFEQMSQQFNQGLSLSGKIPCGLFNNMFNFTGSWQKNSSNTKHLALDGWFYTLYNMEMPRSQLVLKEDIKASVPSSWEPVALARFIETFGTHIVVGVKVGGKDVVYMKQHQSSPSTSIEFQKLLAEVSDERFLRSEGRASVGSKDSRSNKKHNIEFQPWSAHLDTFSQMSYNEKHHVTIIPRRKGGFDHGQSHSEWIHTVPLAPDIISVSLIPITFLLHGVAGSGFLSHASNLYLRYKPPIEELRQFLEFQLPREWAPVYSELPLTLPRREPSLSTLQFTFMGPKLKVSKLEVAVGKKPVTGMRLFLEGKRCDKLAIHLQHLSAIPRFLQPLWEDHPFSREVTWQDPDDYSTKYFEPVQWKNFSHVCTAPVENTETWIGDHAGASVVVGAQLGVKSFGLRNVLYLRLIRRSEWDHMPASTQKSGMFSSFLSTTFSSIPALPKVPAVVMNSGIYPEGPPKPVQDPKLLKFVDTTEMTKGPQDMPGHWLVTGAKLYLDKRKISLRVKYSLLTVSSDGP

SEQ ID NO: 215 - protein, 565 aa, Sphaeropteris cooperi
MASARESGRAVARAAVEALGCGFDLTADYRLKYRKGPLLNLQHSRKDLLIPGGITIPNVSRDVKCDKGERTRFTSEVMKFQQMSQWFNKNAFVEGKIPLGFFNAMFDLSGSWQHDASLTKSLAFDGCFITLYKLHLTRSNLVLREEVKKDIPSTWDPEGLARFIEKYGTHIIVAVNIGGQDVLYLKESHSSLLSTQDIHKHLKIAGDKCFSDGSGERSIDFKENEDVTIISQRRGGIVSSKTHSKWQETVDSSPDAISFSFVPITSLISGVSGSGFVQHAINIYLRYKPPVENIRYFLDFQVPRQWIPVYNELPLGLSRKQALSQSLQFSLMGPKLHVNTLQVVVIKKPVTGVRLYLEGRKSNRLAIHLQHLSVLPQCLEQFWNENAPIEQPRWHSSNEATKNWFEPVQWKSFSHVCTMPVKYKPEWLDKKGGIFVVTGARLEVKMHGLTSALHLYLLFTKIPECTIQTSRWDKPPASEKTRYFSSLSSKAGKKKATPVVMNSAVYPGGPPKPIQRRKLLKFVDMTELTKGPQDVPGHWIVTAARLELGRGKISTRVKYSLLNYS

SEQ ID NO: 216 - protein, 376 aa, Phormium (Lancer Terra Cotta)
MALKFPPRKAAEFAINSIGLGYDVAADIRLKYCKRETQDPCLIELDKDQLQDIVLPGGITVSNVPKSIKCDKGERTRFRSDVLSFQQMSEQFNQELSLSGKIPSGLFNYMFEFSNCWQKDAANTKSLAFDGWFITLYTVALAKSQIVLRDHVKQAVPSSWDPAALARFIEKFGTHVIVGVKMGGKDVIYVKQQHFSNLQPAEVQKILKDMADKRFLDVSGQYGMNSEEAFGKDKFDFKEQRLRFADSSSSSSYSTKEDIVRIFKRRGGNDNKDLPHPEWLNTVQYEPDVISMSFVPITSLLQGIPGSGFLSHAINLYLRYKPPTEELHQFLEFQLPRQWAPVFSDLPLGPQRKHQSTASLQFTFMGPKLYVNTSVW

SEQ ID NO: 217 - protein, 403 aa, Nephrolepis cordifolia (Duffii)
MQPQSSAAAPPQNTPFSVAQQAVGALGRGYDVNSDLWLRYCKRGAQLIENKPGPTQDLHLPGNIVIPNVPSSVKCDKGDRTRFTSDILTFNEMSEQFNQNLSISGKIPVGHFNAMFGFSGSWQKDASVVKTLAMDGVFITLYSVELPRTQITLKEEVRAAVPSSWDPAALASFVEKYGTHVIVGVKIGGKDAICLKQHRSSSLSAVEVQKILETKAKERFLSVEGNTAKERINKGKIRDGSPYGSNGMAALNLSKDETTLSWLSDTSTDHSTVETNDVTVIFKRKGGRENSTSHDEWLHTVASFPDIVSMSFVPITSLLNGITGTGFLSHAINHYLRYKPPIQELHHFLEFQLPKEWAPAFGDLPLGPSRKQPGSPSLQFRLMGPKLQVNTTPVVIGKRCVIR

SEQ ID NO: 218 - protein, 404 aa, Sphaeropteris cooperi
MMSSADVHKHLKNLGDQMFAEKGVQKIQDGNSLRGCSIAPVEIDGTNILYKSKDLTIIAKKRGGRLCAKTPSEWQATVMSAPDVIMMSFVPITALLSGTPGSGFLNHAINLYLRYKPPIEDIRCFLEFQVPRQWAPVYSDLPLGPPQRAITLPSLQFCLMGPRLYVNTAQISVGRKPVTGLRLYLEGRQNNRLAIHLQHLASLPRVLEPYWNPEIHEQSNWHGSDNVESSEWFEHVQCRTFSHVCTARVKYNPVWTRSKSGVFVVTGAQLEVKSYGLKNVLHLRLQFARIPGCTILKSQWYQPRSTTLSEKSRFFSTLSTAFTSQMVKKTLKPSPLVLNSGVFLGEPPRPIQRPKLLKVVDTTELTKGPQDMPGHWLVIGAQLDVDGGKISLNAKYSLLNFDFK

SEQ ID NO: 219 - protein, 644 aa, Asplenium australasicum
MASAVGRFAATQAQSSEAAQPQITSSPAFSIAQQAVDALGRGYDVNFDLRLGYCKQRKHLIENDELGPTQDLLLPGNISIPNLPASIKCDKGDRTRFTTEILTFNEMSEQFNQDLSISGKIPTGHFNNMFDFSGSWQKDASQVKTLALDGFFINLYTVELPRAQLTLKEEVRAAVPSSWDPAALASFVEKYGTHVIVGVKIGGKDVICLRQHHSSQLSAVGVQKILEAKAKERFTSIAGGTSRENNKGKIRDGFTYGSNAMIAVNGSKDGVHPSWLNSSLSDLPPVETDDVKVMFKRKGGKAVSQSHEEWLHTVPSSPDIVSMSFVPITSLLNGVTGTGFLSHAINHYLRYKPPIDQLRHFLEFQLPKDWAPAFGDLPLGPPRKQQASPSLQFRLMGPKLQVNTTPVVVGKRCVTGIRLHLEGKKSNRLAIHLQFLTVVPQILQSRWEDDQLEDWEGPDTDFSKYFEPVMWRSFSHVCTAPVESREPWAADEMAGEAALKGALVVTGAQLDVEQHGSKKVLFLRLLYSKIHKAMNRRSEWDHTPASSQRSGIFSTLISTPFSSAAASSPAAAKPVHVNSAIYPDGPPPANSQAPKLLKFVDTSEMTRGPLDLPGHWLVTGAKLCVERGKIAVRAKYSLLLYSED

SEQ ID NO: 220 - protein, 517 aa, Asplenium antiquum (makino)
MASTVGGLAAMQAQSSEAAQPPNMSFTAFSIAQQAVDALGRGYNVNLDLSLSYCKQGKRLIEIDESGPTQDLLLPGNIIIPNMPASIKCDKGDRTRFTTEVLKFNEMSEQFNQNLSISGKIPTGHFNTMFNFSGSWQKDASQVKTLALDGFFINLYTVELPRAQLTLKEEVRAAVPSSWDPAASWDPAALASFVEKYGTHVIVGVKIGGKDVVCLKQHHTSQLSTIRVQKILEEKAKERFTPIAGGTSKEKINKGKIRDGSPYGSNAMNGSKDGLSLSWMNDSLSDLLTVETDDVRVMFKRKGGKDVSQSHEEWLHTVPAAPDIVSMSFVPITSLLSGVMGTGFLSHAINHFLRYKPSIAELHHFLEFQLPKEWAPAFGDLPLGPPRKQQASPSLQFRLMGPKLQVNTMPVVVGKRCVTGIRLHLEGKKSNRLAIHLQYLTAVPQILQGLWEDHRPDNWEGPDTDFSRYFEPVMWRSFSHVCTAPVESKEPWVDEMKGEPVLKGALVVTGGPPAALL

SEQ ID NO: 221 - protein, 640 aa, Asplenium antiquum (Crissie)
MASAVGRFAATQAQSSEAAQPQITSSTAFSIAQQAVDALGRGYDVNFDLRLGYCKQRKRLIENDELGPTQDLLLPGNIIIPNMPASIKCDKGDRTRFTTEVLTFNEMSEQFNQDLSISGKIPTGHFNNMFDFSGLWQKDASQVKTLALDGFFINLYTVELPRAQLTLKEEVRAAVPSSWDPSALASFVEKYGTHVIVGVKIGGKDVICLKQHHTSQLSAVGVQKILEAKAKERFTSIAGGTSKENNKGKIRDGFSYGSNAMNAVNGSKDGVHPSWFNDSLSDLPPVETDDVKVMFKRKGGKAVSQSHEEWLHTVPAAPDIVSMSFVPITSLLNGVMGTGFLSHAINHFLRYKPSIAELHHFLEFQLPKEWAPAFGDLPLGPPRKQQASPSLQFRLMGPKLQVNTMPVVVGKSCVTGIRLHLEGKKSNRLAIHLQYLTAVPQILQGLWEDYQPESWEGPDTDFSKYFEPVMWRSFSHVCTAPVESKEPWVDEMKGEPALKGALVVTGAQLDVEQHGSKKVLFLRLLYSKIHKVRIRRSEWDHTPASQQRSGIFSTLISTHFSSAPSSPSKPVQVNSAIYPDGPPLANSQAPKLLKFVDTSAMTRGPLDLPGHWLVTGAKLDVERGKIAVRAKYSLLLYSED

SEQ ID NO: 222 - protein, 572 aa, Tupidanthus calyptratus
MEGGEETVKPIGLRAMESLGLGFDFASDFRLKFAKRCPGAGGDDRLVVLDEASRRDVVFPGGGVIRGVPECIRCDKGDRIRFKSDVLKFNQMSELVNQKSSVQGKVPSGYFNAMFDLSGSWFNDAADSNHLAFDGYFISLYYLHLIASPLVLRDKVKNSVPSHWNPASLSRFILTYGTHIIVGLAVGGQDVICVKQRPSSGIPPAELRGYLEDLGDCMFSDGRNPVLERKTRDGKQKVPEVFNRMLQSHTMQFSSITETSSKDGLTILSSKRGGDVFSQNHSNWLQTVASNPEAICFKLVPITSLLTGVPGSGYLSHAINLYLRYKPAPEDLRYFLEFQVPVQWAPLFCELPLRHQRRKASCPLLQFAFLGPKIHVSSTQVTSGEKPVVGLRLFLEGKKCNRMAIHAQHLSSLPNIMEFALSNSATSRPCQWRGSDDYISNDQFLEPVRWKRYSNVCSSVVEHDSNWIQGEEVGAFVVTGAQLISKGKWPKTILHLRLLFSYLPNCTIRKTEWAAAPEASQKSGFRLNLSTTSATSTYLSSFLERSGTGGPSGYTPEFSAAGSCFGASAPVR

SEQ ID NO: 223 - protein, 603 aa, Tupidanthus calyptratus
MALKVSAPEAAKIAIQSIGCGYDISLDLRLKCCKGDPANPRLIEIHEDQGREIVLPGGIVIPNVSKAIKCDKGEHARFRSDVLSFQQMSEQFNQEMSLTGKIPSGVFNTMFEFTGSWQKDAANTKTLAFDGVFITLYTVALEKTQMILSDHVKQAVPSSWDPAALARFIEKFGTHIIVGVKMGGKDVIYMKQQHSSSLQPSDVQKRLKTIADKRFVDASGQYGMDSEQTHQNDKFQIREQRLRFADTSPSSSYSYKEDIVIICKRRGGSDNKNLTHNEWLHNVQLEPDVISMSFIPITSLLNGVSGSGFLSHAINLYLRYKPPVEELHQFLEFQLPRQWAPVFSDLPLGPQRRQQSTSSLQFSLMGPKLYVNTTPVDVGKRPVTGLRLYLEGKRSNRLAMHMQHLSSLPKVFQLKDDPNGNFRQESYDRRYYEKVQWKNFSHICTAPVESDEDLSIVTGAQLEVGDYGFKRVLFLRLRFSTVLGAVAVKHPEWDGSPGLARKSGLISTLISHHFTATLKPPPQPADVNINSAIYPGGPPAPTQSAKLLKFVDTTEMTRGPQETPGYWVVAGARLMVEKGRISLRVKYSLLTVILPDEEALEEP

SEQ ID NO: 224 - protein, 386 aa, Tupidanthus calyptratus
MALKVSAPEAAKIAIQSIGCGYDICLDLRLKYRKRDSTNLSLIEIHEDQEKEIVLPGGILIPNVSKAIKCDKGEHARFRSDVLSFQQMSEQFNQEMSLTGKIPSGVFNTMFEFTGSWQKDAAHTKTLAFDGLFITLYTVALDKSQMVLSDHVKKAVPSSWDPAALARFIEKFGTHIIVGVKMGGKDVIYMKQQHSSSLQPSDVQKRLKTIADKRFVDARGQSGMDSEQTYQKDKFQVREQRLRFADTSLSSSYSYKEDIVSICMRRGGNDNKNLTHNEWLHNVQLEPDVISMSFIPITSLLNGVSGSGFLSHAINLYLRYKPPTEELHQFLAFQLPLHWAPVFSVHPLGLQPRQQSTASLQFSFMGPKLHVNTSPVDVGKRPVTGL

SEQ ID NO: 225 - protein, 550 aa, Tupidanthus calyptratus
MEGGEETVKPIGLRAMESLGLGFDFASDFRLKFAKRCPGAGGDDRLVVLDEASRRDVVFPGGGVIRGVPECIRCDKGDRIRFKSDVLKFNQMSELVNQKSSVQGKVPSGYFNAMFDLSGSWFNDAADSNHLAFDGYFISLYYLHLIASPLVLRDKVKNSVPSHWNPASLSRFILTYGTHIIVGLAVGGQDVICVKQRPSSGIPPAELRGYLEDLGDCMFSDGRNPVLERKTRDGKQKVPEVFNRMLQSHTMQFSSITETSSKDGLTILSSKRGGDVFSQNHSNWLQTVASNPEAICFKLVPITSLLTGVPGSGYLSHAINLYLRYKPAPEDLRYFLEFQVPVQWAPLFCELPLRHQRRKASCPLLQFAFLGPKIHVSSTQVTSGEKPVVGLRLFLEGKKCNRMAIHAQHLSSLPNIMEFALSNSATSRPCQWRGSDDYISNDQFLEPVRWKRYSNVCSSVVEHDSNWIQGEEVGAFVVTGAQLISKGKWPKTILHLRLLFSYLPNCTIRKTEWAAAPEASQKSGFRLNLAQLSHSVSELVLMHQSSFQLH

SEQ ID NO: 226 - protein, 614 aa, Bignonia chamberlaynii (Bureau)
MAYYSSSNVRMDPQLAAEKAVSVIGFGYDLTSDIRLSACKPGPSGSGLIELDRTRRKDLVVPGNVVVPNVSASIKCDKGERTRFSCDALSFSQMSEHFNQELSLSGKIPSGMFNAMFGFKGCWQSDASTTKILAFDGWFISLYRIELERSQITLSDKVKQEVPTTWDPAALAEFIDKYGTHVVVGVKMGGKDVIHIKQLQNSNLQPTEVQKLLKQLADERFCEDGNRNSVANANVSSGKPKVEQSMMWDLPLPFASTVRPPIVSHSKNNDLLSIHIRRGGLDVGQSHNQWLSTVSQHPNVISLSFVPIASLLSGIRGSGFLSHAINLYLRYKPPPEELSQFLEYQLPRQWAPAYNDLPLGPRRKKKASPSLQFTLLGPKLYVNTVKVDAGNRPVTGIRLYLEGKRSDHLAIHLQHLSTLPQSLQLSPDHSYEPSDESVDRGYFEPVKWSIFSHICTAPVEYHGARIDDSASIVTKAWFEVKGIGMKKVLFLRLGFSMVASAISRRSEWDGPTMASKKSGLISMLMSTPFSTALNQPDKPAKVDLNSAVYPGGPPSPAKAPKMSHFVDTKEIVRGPEDPPGYWVVTGAKLCVESGMIRIKVKYSLLTIVSEDSFC

SEQ ID NO: 227 - protein, 281 aa, Tupidanthus calyptratus
MEGGEETVKPIGLRAMESLGLGFDFASDFRLKFAKRCPGAGGDDRLVVLDEASRRDVVFPGGGVIRGVPECIRCDKGDRIRFKSDVLKFNQMSELVNQKSSVQGKVPSGYFNAMFDLSGSWFNDAADSNHLAFDGYFISLYYLHLIASPLVLRDKVKNSVPSHWNPASLSRFILTYGTHIIVGLAVGGQDVICVKQRPSSGIPPAELRGYLEDLGDCMFSDGRNPVLERKTRDGKQKVPEVFNRMLQSHTMQFSSITETSSKDLRASIPHLSHPFSSDLIY

SEQ ID NO: 228 - protein, 540 aa, Waldsteinia ternata
MFLQMSELLNQKSSVQGMSELLNQKSSVQGKIPSGYLNSIFGLSGDWLQDAAETKYLAFDGFFISLYNLHLTASPLVLRNKVQKSVPSRWDPAALSRFIHSYGTHIIVGMAVGGQDLVCVRQKSSSPVPPADLRRNLEDLGDFLFSDGPSLLRGKTRNGKQKIPEVFDRILQSNTMQLTTISETSSKDGLTVVCSKRGGDVFLNSHSNWLQTVLAEPEAIIFKFVPITSLLTGLPGSGYLSHAINLYLRYKPDLEDLQHFLEFQVPRQWAPMFCELPLSHQRKKASCPSLQFSFMGPKILVSSMQVSTSQKPVVGLRLYLEGKKCNRLAVHVQHLSSLPNTMELKLANTRTTRPSWWRGSDDSEFSGQFLEPIKWKRYSSICSSVVRYDPNWLKGDPGGVYIVTGAQLLSKGKWPKTILHLRLHYTFLPSCAIRKTEWAGSPEPSHKSTFLMNLSTTFTMTQRTVTDQQKQDPAALNSGVYPEGPPVLNRSAKLLKFVDTAEVVRGPHDAPGHWLVIAAKLVKEGNRIGLHTKFALLDYW

SEQ ID NO: 229 - protein, 316 aa, Marsilea mutica
MTTTTSRPNSVATAEQAVRCLGKGYDVVNDLWFRYCKGDDRLIEIDQSRPSQELVLPGNITLSEIPACVKCDQGDLTRFATDVISFNEMSEHFNKSLSITGKIPLGHFNSMFQFSGSWQKDASSVKALAYDGVFKSLYSLQMPTTLLTLKEEVKASMPSSWDPRALANFIENYGTHIIVGVTIGGRDVVCLKQLHGSSLSGDRVRKFLESSANERFLASGVSSHNAKGNSHKDDIGYNFINNVAMNEETILKDDMVNIILMRFTRKSFCILPGSLAGCLKFKNDKFNIQFSWFFTLQIVFFYIKISARVFYSCRMT

SEQ ID NO: 230 - protein, 611 aa, Phormium (Lancer Terra Cotta)
MRPTDLMTPEAAAAAAVSAVGYGYDLVGDLRLSSCKAGPSGSRLIKIDDALVHDLVLPGGVVVPNVPKEIRCDKGERTRFRSDVLGFHQMAEQFNQDLSLSGKIPSGLFNAMFDFRGCWQKDLSSTKSLAFDGWFITLYSIELAKSHIVLQDKIKQEIPSSWDPVALAEFIEKYGTHIIVGIKMGGKDAVSIKQLQESALQQTEVQNLLKNLADDAFSEDFNANILLGAAEISKRLKGIKLANQENNAAVLKSMNSSIVTHLKKDDIVSIHVRRGGINTKQSHNQWLSTISQAPNVISMSFVPITSLLTGVRGSGFLSHAVNLYLRYKPPIEELHHFLEFQLPRQWAPVFNEIPLGPQHRKRRRLPSLQFTLMGPRLHVNTDKVDSKNRPVTGIRLFLEGKRNDCLAIHLQHLSTRPNIFQLSNDSDHTSADDISLNQRDYYEPIKWALLSHICTAPVQYSGASIDDSASIVTKAWLEVKDIGMRKVLFLRLGFSNVVGMKIRRSEWDGLTNVTRKSGSISAMISSRFSTGMIPPQKPKVEINSAVFPGGPPVPIRVPKMSRFVDTTEMMRGPDDLPGYWLVTGAKLCVEGGGISLKVKYSLLVPKPEDEL

SEQ ID NO: 231 - protein, 471 aa, Tupidanthus calyptratus
MGSSKEIGLKLKATAEAAIQSIGFGYDITEDLRLKYCKGSRLIVIDDDQVRDIVIPGGILVPNVSKQINCDKGERIRFSSDGLSFQQMSEQFNQEVSLSSKIPTGHFNAAFQFTGCWQKDAANTKTLALDGVFITIYTIALEKSQITLCDHIKEAVPSSWDPAALARFIEKFGTHVIVGVKMGGKDIVYMKQQHSSPLQSDEVQKRLKHVADNRFSNASGHSTNPEKVYEREMLEINEPPQEFMDDSASSSYMDLEDITFFYRRRGGSNKKNLPHDKWCQSVQLEPDVISMSFIPISSLLSGINGNGFLTHAINLYLRYKPAIEELSQFLEFQHPRQWAPVFGELAVGPERKQQSGASLQFSFLGPKLYVNTTLVDAGKRPVTGLRLYLEGTKSNCLAIHLQHLSTLPKSFQLQDEATCNYGSNDQRYYEKVQSKSFSHVCTGPVESDEDHSIVTGAQFEVRNSETTSTAI

SEQ ID NO: 232 - protein, 381 aa, Tupidanthus calyptratus
MFSDGRNPVLERKTRDGKQKVPEVFNRMLQSHTMQFSSITETSSKDGLTILSSKRGGDVFSQNHSNWLQTVASNPEAICFKLVPITSLLTGVPDKPAPEDLRYFLEFQVPVQWAPLFCELPLRHQRRKASCPLLQFAFLGPKIHVSSTQVTSGEKPVVGLRLFLEGKKCNRMAIHAQHLSSLPNIMEFALSNSATSRPCQWRGSDDYISNDQFLEPVRWKRYSNVCSSVVEHDSNWIQGEEVGAFVVTGAQLISKGKWPKTILHLRLLFSYLPNCTIRKTEWAAAPEASQKSGFRLNLSTTFTFSQRTGADAPKQLPAALNSGVYPEGPPVPLRSKKLLKYVDVAEVVRGPHDTPGHWLVTAAKLVTDGGKIGLHVKFALL

SEQ ID NO: 233 - protein, 595 aa, Vernonia noveboracensis
MGSSNKEVALRLKAAAESAIGAIGLGYDVTEDLRLKYCKGKSAADRLIGIDDERVRDILIPGGILIQNVSKSINCDKGERMRFSSDILPFQQMAEQFNKDVSLTGRIPTGQFNAAFEFTGSWQKDAANTKALALDGVFITLYNITLEKSQIALRDHVKYDVPSSWEPAALAKFIEKFGTHVIVGVKMGGKDIVYMKQQQLSTLPSDEVQKKLKDVAEKRFSGLHVDNPRRTHDPELLERNDYGLITLDPAIEDITLFWRRRGGTYGKNLNHRTWCQTVQLEPEVISFSFVPITSLLSGIDGNGFLTHAINLYIRYKPPIEELQQFLEFQLPTRWAPEFGELAVGPEGKQQHSASLQFRFLGPKLYVNTNQVDVGDKPVTGLRLYLEGKRNDCLAIHLQHLSSMPKSFKLASEPNMNPATSPRDRRYYEKVQWKSFSHVYSAPVESDDELSIVTGAEFEVNDSGSKRVLFLRLRFAKVIGATVVRQPEWDGSPVLTQKSGIVSTMISSRFSSAQRPPPQPTTVNMNSALPGGPPVSAQGKKLLRFVDTMELTRGPQDLPGYWVVSGARLVVDKSKISLRAKFSLLAVISADEKALQ

SEQ ID NO: 234 - protein, 967 aa, Dryopteris erythrosora
MDLNDLYLQPDGPCTVRLHVGGLGPSVISSDLVQIFSSLAKVSCVDLVHTKGRNFAYVTIQAASRDIKRLFGLYNGCMWKGGRLKLEKAREFYLDKLHREWADRDCLQAIQIPNLGCSTTARSVVKSKDSSSFNIYIPKLRKVKAIPEKGLGKHKRSFERVDPLPYSLLQNCNCDQHCTATSKYQSRTKKELSDSKHATIKASPNETSTQCEQVFKPSGYKDRKGFEKKPGIYWKSGDAWGSNEVPALDESVLKGGVAHSEEGDTECITNIDEPVLNMTGLNDLCLGKTKDLVEEEVRAVIKEQAQACIEDAQQVVEGVSSLQRKRLKSDLDTWTSNKNKHLGEVGKSTDLMLQRGETYESKAFKNLPGKSWVQKASWKSLVGETGRMSFSLGSMLDQNLIVGNLESTTSIKCDKGDRTRFTSDILTFNEMSEQFNQNLSIAGKIPVGHFNAMFGFSGSWQKDASMVKTLAMDGVFINLYSVELPRAQLTLKEEVRAAVPSSWDPAALASFVEKYGTHVIVGVKIGGKDVICLKQHRSSSLSAVGVQKILQSKARERFSSVDGCAAKEKINKGKIRDGSPYGSNGINAVNVLKDGMPLPWISDSSTDLSTVETDDVTVIFKRKGGRDASQSHAEWLHTVASTPDIVSMSFVPITSLLNGVTGTGFLSHAINHYLRYKPPIQELHHFLEFQLPKEWAPAFGDLPLGPPRKQAGSPSLQFRLMGPKLQVNTTPVVIGKRCATGLRLHLEGKKSNRLAVHLQYLTVVPQILQRLWEDDQPEEWEGPDDDFSKYFEPVMWKSFSHVCTAPVESSESWEDEGKGEAGPKGALVVTGAQLDVEQHGSKKVLFLRLLYSKIHKARIRRSEWDHTPASQQKSGIFSTLMSTTFSSAQAAPPKPVQVVVNSAIYPQGPPPTKSQAPKLLKFVDTTEMTRGPLDLPGHWLVTGAKLFVDRGKIAVRAKYSLLLYSVD

SEQ ID NO: 235 - protein, 640 aa, Matteuccia struthiopteris
MSSPVGGLAATQAQSSEGALPQNINASLAFSVAQQAVNALGRGYDVNSDLWLRYCKRGERLIENDNSGPTQDLLLPGHIIIPNVPTSIKCDKGDRTRFTSDVLTFNEMSEQFNQNLSISGKIPVGHFNAMFGFSGSWQKDASQVKTLAMDGVLINLYSVELPRAQLTLKEEVRAAVPSSWDPAALASFVEKYGTHVIVGVKIGGKDMICLKQHRSSSLSAVGVQKILETKAKERFSYAESSAAKEKINKGKIRDGSTYESNGMNAVNGSKDGMPLSWMSDLSTDLETDDVTVIFKRKGGKDLSQSHDEWLHTVASAPDIVSMSFVPITTLLNGVTGTGFLSHAINHYLRYKPPIQELHHFLEFQLPKEWAPAFGDLPLGPARKQQGSPSLQFRLMGPKLQVNTTPVVIGKRCVTGLRLHLEGKKSNRLAVHLQYLTVVPQILQRLWEDDQPEEWEGPDEDFGKYFEPVMWKSFSHVCTAPVESNEAWVDEAKGEPGPKGALVVTGAQLDVEQHGSKKVLFLRLLYSKIDKATIRRSEWDHTPASQQKSGIFSTLMSTPFSAHAAPLKPSQVVVNSAIYPEGPPPAKSQAPKLLKFVDTTEMTRGPLDLPGHWLVTGAKLFVDRGKIAVRAKYSLLLYSVD

SEQ ID NO: 236 - protein, 451 aa, Tupidanthus calyptratus
MALKLPAPEAAKIAIQSIGCGYDICLDLRLKYRKRDSTNLSLIEIHEDQEKEIVLPGGILIPNVSKAIKCDKGEHARFRSDVLSFQQMSEQFNQEMSLTGKIPSGVFNTMFEFTGSWQKDAAHTKTLAFDGLFITLYTVALDKSQMVLSDHVKKAVPSSWDPAALARFIEKFGTHIIVGVKMGGKDVIYMKQQHSSSLQPSDVQKRLKTIADKRFVDASGQYGMDSEQTHQNDKFQIREQRLRFADTSPSSSYSYKEDIVIICKRRGGSDNKNLTHNEWLHNVQLEPDVISMSFIPITSLLNGVSGSGFLSHAINLYLRYKPPVEELHQFLEFQLPRQWAPVFSDLPLGPQRRQQSTSSLQFSLMGPKLYVNTTPVDVGKRPVTGLRLYLEGKRSNRLAMHMQHLSSLPKVFQLKDDPNGNFRQESYDHRYYEKVQWKELLPHLHCPSRIR

SEQ ID NO: 237 - protein, 597 aa, Tupidanthus calyptratus
MALKLPAPEAAKIAIQSIGCGYDISLDLRLKCCKGDPANPRLIEIHEDQGREIVLPGGIVIPNVSKAIKCDKGEHARFRSDVLSFQQMSEQFNQEMSLTGKIPSGVFNTMFEFTGSWQKDAAHTKTLAFDGLFITLYTVALDKSQMVLSDHVKKAVPSSWDPAALARFIEKFGTHIIVGVKMGGKDVIYMKQQHSSSLQPSDVQKRLKTIADKRFVDASGQYGMDSEQTHQNDKFQIREQRLRFADTSPSSSYSYKEDIVIICKRRGGSDNKNLTHNEWLHNVQLEPDVISMSFIPITSLLNGVSGSGFLSHAINLYLRYKPPVEELHQFLEFQLPRQWAPVFSDLPLGPQRRQQSTSSLQFSLMGPKLYVNTTPVDVGKRPVTGLRLYLEGKRSNRLAMHMQHLSSLPKVFQLKDDPNGNFRQESYDHRYYEKVQWKNFSHICTAPVESDEDLSIVTGAQLEVGDYGFKRVLFLRLRFSTVLGAVAVKHPEWDGSPGLARKSGLISTLISHHFTATLKPPPQPADVNINSAIYPGGPPAPTQSAKLLKFVDTTEMTRGPQETPGYWVVSGARLMVEKGRISLRVKYSLLAAILPDE

SEQ ID NO: 238 - protein, 386 aa, Tupidanthus calyptratus
MAFNANRFDPQSAAEKAVSAIGSGYDLTVDIRLSECKPGPSGSGLIELDRTLTKDLNLPCGRVVRNVSPSIKCGKGEQTRFHSDVLTFVQMSEQFNQDISLSGKIPSGLFNAMFDFKGCWQKDAATTKSLAFDGWFFSMYNIELARSQITLSEQVKKEVPSSWDPAALAEFIEKYGTHIVVGVKMGGKDVIHLKQLQNSNLQPTEVQKLLKQLADERFSEDVNGSLIPNPEKSSGKQKEEPSIVQDLNLPFANLLRQAVVSQSKNDDLLSIRIRRGGFDTGQSHKQWLSTVSQFPNAISMSFVPLASLLSGIRGSGFLSHAINLYLRYKPPMEELEQFLEFQVPRQWAPVYGDLPLAPRRKKQASPSLKFTFMGPRLYVNTIRVDS

SEQ ID NO: 239 - protein, 429 aa, Tupidanthus calyptratus
MGGKDVIHLKQLQNSNLQPTEVQKLLKQLADERFSEDVNGSLIPNPEKSSGKQKEEPSIVQDLNLPFANLLRQAVVSQSKNDDLLSIRIRRGGFDTGQSHKQWLSTVSQFPNAISMSFVPLASLLSGIRGSGFLSHAINLYLRYKPPMEELEQFLEFQVPRQWAPVYGDLPLAPRRKKQASPSLKFTFMGPRLYVNTIRVDSENRPVTGIRLYLEGKKSDHLAIHLQHLSTPPKRLQLSDDLSYEPIDEPAEKGYLEAVKWSMFSHICTQPVQYNGARIDDSASIVTKAWFEVKGIGMKKVLFLRLGFSTVASAVIRRSEWDGPTMSTRKSGLMSMLISTRFSTGLTEKPELRKKLDLNSAIYPEGPPLPTRAPKMLSFVDTKETVRGPEVPPGYWVVTGAKLCVEGGRIRVKVKYSLLTIMSEDSLFI

SEQ ID NO: 240 - protein, 268 aa, Lygodium japonicum
MGTTRESSALAVAQAAIEALGCGFDVTANYRLKYCKCPVVQLPQTRVEDMLIPGGITILNVPRDITCDKGEMVRFTSEVMEFQQMSQWFNKNSSIEGKIPLGYFNAMFDLSGSWPDDATQTKSLAFDGFFITLYKLQLSRINLVLRDEVLSDIPSTWDPKSLAQFIEKYGTHIIVAVNIGGQDVLYLKENRSSSLSAKEIQRHLKLAGDLCFTDGGNNRTLVSKENEMYSLTSQASVAMHSAQLFITNKVSLETICIGKCGVCSGSTI

SEQ ID NO: 241 - protein, 346 aa, Tupidanthus calyptratus
MEGGEETVKPIGLRAMESLGLGFDFASDFRLKFAKRCPGAGGDDRLVVLDEASRRDVVFPGGGVIRGVPECIRCDKGDRIRFKSDVLKFNQMSELVNQKSSVQGKVPSGYFNAMFDLSGSWFNDAADSNHLAFDGYFISLYYLHLIASPLVLRDKVKNSVPSHWNPASLSRFILTYGTHIIVGLAVGGQDVICVKQRPSSGIPPAELRGYLEDLGDCMFSDGRNPVLERKTRDGKQKVPEVFNRMLQSHTMQFSSITETSSKDGLTILSSKRGGDVFSQNHSNWLQTVASNPEAICFKLVPITSLLTGVPGSGYLSHAINLYLRYKPAPEDLRYFLEFQVPVRKCP

SEQ ID NO: 242 - protein, 519 aa, Marsilea mutica
MSEHFNKSLSITGKIPLGHFNSMFQFSGSWQKDASSVKALAYDGVFKSLYSLQMPTTLLTLKEEVKASMPSSWDPRALANFIENYGTHIIVGVTIGGRDVVCLKQLHGSSLSGDRVRKFLESSANERFLASGVSSHNAKGNSHKDDIGYNFINNVAMNEETILKDDMVNIIRKQRGGKQCLQSHKEWLQTVKDFPDILSMHFVPITSLLTGVTGSGFLNHAINLYLRYKPPIEELRYFLEFQLPKEWAPAFGDLPLGPPRKQIESPALQFRFMGPKLQVNTTQVTVGKRPVTGIRLHLEGVKGNRLAIHLQYLTVVPQILQPLLEENKDIEGQWHGPESDGDYSKYFEPVMWKSFSHVCTAPVETIDAWSEEDVDATIVTGAQLRVEQHGTKKVLVLWLLYTKIPKVGIRRPEWDHSPASQQKSGIFSTLLSTTFSSQQAQTVNKPAVQVNINSAINPYGPPTAKTHSPKLLKLVDTNEMTRGPTCQPGHWLVTGAKLAVENGKIAIKPKYSLLMYRTE

SEQ ID NO: 243 - protein, 611 aa, Schizophragma hydrangeoides
MAFNANRFDPQSGAEKAVSVIGYGYDLSADIRLSACKPGPSGSRLIELDQTLTKDLVLPGGVVVPNVSTAIKSDKGERTRFRSDVLSFNQMSEQVNQGLSLSGKIPCGVFNTMFNFRGCWAKDTAATKTLAFDGWFITLYNVELTRSHITLSKQVKHELPSVWDPAALAEFIEKYGTHIVVGVKMGGKDVIHIKQLQNSNLQPTEVQKLLKRLADERFSEDVNDSSIPGPNTLAAKLKDDSLFWDVNTPFASSIRPSVTSHSRNDDLLSIHIRRGGIDHGQSHNHWLSTVAKSPNVVSMSFVPIASLLSGVRGSGYLSHAINLYLRYKPPIEDLHQFLEFQLPRVWAPEYGDFPLGTRLKKQPSPSLQFTFMGPKLYVNTAKVDSGNRPVTGLRLYLEGKKSDHLAVHLQHLTTLPEILQLSEDPSYEPIDEPVERGYFEPVKWSIFSHVCTAPVQYNGARIDESASIVTKAWFEVRVMGVRKVLFLRLGFSSMASARIRRSEWDGPTSSSRKSGVMSMLMSTTFTTGMTPIEKPTKVELNSAVYPGGPPLPLRAPKMSYFVDTKEMVRGPEDLPGYWVVTGAKLCVEGGRIRIKVKYSLLTIMSEDSMLM

SEQ ID NO: 244 - protein, 327 aa, Waldsteinia ternata
MSEQYNKELSLSGKIPSGLFNAMFNYSGCWQKDAAPTKYLAFDGWLITLYSIELARSQLRLSEQVKRDVPSLWDPAALAAFIEKYGTHIIVGVKMGGKDIVHIKQLQNSKLEPAELQRRLKQVAEERFSDDANETSASNPTADLFGMMKDDNPLHWDIQRTLASSIKPPIVTHSMDDDVVTISVRRGGVDIGQSHNQWLSTISQAPNVISMSFVPITSLLGGTQGNGFLIHAVNLYLRYKPPIEELQQFLEFQLPRQWAPVYADLPLGLKRRRHASPSLQFSFMGPKLYVNTVKVICCAVKSGHAVDQLRKFSCLWNFHCRNGNCGE

SEQ ID NO: 245 - protein, 628 aa, Platycerium bifurcatum
MASAKEAAALAAVEALGCGFDLTSDYRLKYKKGSLLELQHSHNKDLTIPGCITIPDVSRGIKCDKGEHMRFTSEVMQFQQMSQWFNQNASVEGKIPLGLFNAMFDLSGSWQDDANRLKNLAFDGCFITLYKLHLTRSNLVLREEVKNDIPSVWDPKSLAKFIEKYGTHIIVSASVGGQDVLYLKENYSSLISAQEIRKKLKSAGDEYFSETSGKRNADFKHSETSPLNSQPFRGTIAAGDEYFSETSGKRNADFKHSETSPLNSQPFRGTIAGSAQLLISNKDYTLISQRRGGYYFAKTHCEWQETVNMYPEAISLSFIPITSLLLGAVGSGFLQHAINLYLRYKPPVSDLQYFLDFQVPRQWIPVHNELPLRLARKQAFSPSLQFSLMSPKLYIDNNEVVVSRKPVTGIRLYLEGRKNNRLAIHLQHLSVLPQSLGKFWSEGIQIEAPLWNGSSDAPNEWFEPVEWKCFSHVCTQPIKYKPEWSNEQGSAFVVTGAQLGVKAHGLKSVLHLHLLFSKIPGCSIQRSRWDQHPAAEKTGFFSSISTTFSTTTKAGKKGPPVVVDSAVYMGGPPRPIQSPKLLKFVDTAELTKGPQDAPGHWVVTAARLELDRGKIAIKVKFSLLNYAE

SEQ ID NO: 246 - protein, 608 aa, Polystichium tsus-simense
MAFKHDIPNAAEVANIAIQSLGRGYDLTCDLRFSTCKDVNGTPLIELRNNETLELSLPGGVVVANVPAIVKCDKGERTRFRSDILTFDQMSQQFNQGLSLSGKIPCGLFNYMFNFTGSWQKDASTTRHLALDGWFYTLYTVEIPRSQLVLKEDIKASVPTSWEPAALARFIETFGTHLIVGIKIGGKDVVYMKQHQSSPSTSVDFQKLLAEVSDERFLQTEGRVSVGSKDSRSNKKRSIEFQSWSAHLDTFSQIIHNEKHHVTIIPRRKGGFDHGQSHSEWIHTVPLAPDVISVSLIPITFLLNGVAGSGFLSHAVNLYSRYKPPIEELRQFFEFQLPHEWAPVFNELPLTLSRRENSPSTLQFTLMGPKLKVSKLQVTVGKKPVTGMRLFLEGKRCDKLAVHLQHLSAIPRFLRSLWEDHPFAREVTWQDPDDYSTKYFEPVQWKNFSHVCTAPVENTETWIGDHAGASVVVGAQLAVKSFGLRNVLYLRLLYSKIPEAKIRRSEWDHMPASTQKSGMFSSFLSTTFSSTPVPTKGPAVVINSGIYPEGPPKPVHDPKLLKFVDTTEMTKGPQDMPGHWLVTGAKLYLDKRKISLRVKYSLLTVRSD

SEQ ID NO: 247 - protein, 284 aa, Nephrolepis exaltata (compacta)
MASKLDIPNAAKVANIAIQSLGRGYDLTCDLRFSTFKDVNGASLIELRNNETLELSLPGGVVVTNVPAIVKCDKGEQTHFRSDIVTFDQMSQQFNQGLSLSGKIPSGLFNYMFNFTGSWQKDASTTRHLALDGWFYTLYTVEIPRSQLVLKEDIKASVPTSWEAAALARFIETFGTHIIVGAKIGGKDVVYMKQHQSSPSTSIDFQKLLAEVSDERFAQTEGRTSVGSKDGRINKKKRGIEIQSWAAHLDTFSQLRCQMNDLHRLKVVPVWAQRMAALIKKSVA

SEQ ID NO: 248 - protein, 619 aa, Verbascum chaixii (Vill)
MAYYGHSNARLDAKAAAEKAVSVIGFGYDLTSDIRLSACKPGPSGSGLIELERSRTKDLVVPGNVVVSNVSGSIKCDKGERTRFSSDALTFNQMSEHFNQELSLSGKIPSGLFNTMFGFKGCWQNDASTSKILAFDGWLISLYTIELERSQITLSDKVKQEVPSTWDPPALAEFIEKYGTHVIVGVKMGGKDAIHIKQLKNSNLQPTEVQKLLKQLADKEFSEDENGNPIADPDTSPGKSKVQQSMIWDLHIPFASTMRPSVVSHSKNDDLLSIHIRRGGLDSGQSHNKWLSTVSQYPNVISMSFVPIGSLLSGIRGSGFLSHAINLYVRYKPPLEELTQFLEYQLPRQWAPAYNDLPLGPCLRKKASPSLQFTLLGPKLYVNTIKVDTANRPVTGLRLYLEGKRSDHLAIHLQHLSTLPQSLQLSPDHTYDPGDDSIDRGYFEPVKWSIFSHICTAPVEYHGARIDDSASIVTKAWFEVKGVGMKKVLFLRLGFSMVASAIIRRSEWDGPTSTSKKSGLISMLMSTPFSTALNNNNNQTDKLNKINLNSAVYPGGPPSPAKAPKMSHFVDMKEMVRGPEEPPGYWVVTGAKLCVEMGMIRIKVKYSLLTIVSDESLLM

SEQ ID NO: 249 - protein, 420 aa, Colysis wrightii (Ching)
MKQHQSSPSTSIDFQKLLSEVSDERFLHTEGRTSVGSKDSRSNKKHNIEFQSWSAHLDTFSQNIYNDKKHHVTIMPRRKGGFDHGQGHSDWIHTVPLAPDVISVSLIPITFLLHGVAGSGFLSHAVNLYLRYNPPIEELRQFLEFQLPREWAPVYSELPLTLPRREPSLSTLQFSLLGPKLKVCKLEVAVGKKPVTGMRLFLEGKRCDKLAVHLQHLSAIPRFLQPLWEDHPFAKEVTWQDPDDYSTKYFEPVQWKNFSHVCTAPVENTETWIGDHAGASVVVGAQLAVKSFGLRNVLYLRLLYSKIPEAKIRRSEWDHMPALAQKSGMFSSFLSTTFSSTPALPKAPAVVINSGIYPEGPPKPVRDPKLLKFVDTTEMTKGPQDMPGHWLVTGAKLYLDKRKISLRVKYSLLTVSSDCP

SEQ ID NO: 250 - protein, 609 aa, Nephrolepis exaltata (compacta)
MASKLDIPNAAKVANIAIQSLGRGYDLTCDLRFSTFKDVNGASLIELRNNETLELSLPGGVVVTNVPAIVKCDKGEQTHFRSDIVTFDQMSQQFNQGLSLSGKIPSGLFNYMFNFTGSWQKDASTTRHLALDGWFYTLYTVEIPRSQLVLKEDIKASVPTSWEAAALARFIETFGTHIIVGAKIGGKDVVYMKQHQSSPSTSIDFQKLLAEVSDERFAQTEGRTSVGSKDGRINKKKRGIEIQSWAAHLDTFSQITYNEKHHVTIIPRRKGGFDHGQSHSDWIHTVPLAPDIISVSLIPITSLLHGVSGSGFLSHAVNLYLRYKPPIEELRQFLEFQFPREWAPVFSELPLTLSRREHSVSTLQFTLMGPKLKVSKLQVTVGKKPVTGMRLFLEGKRCDKLAIHLQHLSAIPRFLQPLWEDHPFAREVTWQDPDDCSTKYFEPVQWKNFSHVCTAPVENMETWIGDHAGACVVIGAQLAVKSFGLKNVLYLRLLYSKIPEAKIRRSEWDHMPASTQKSGMFSSFLSSTFSSAPAPAKVPAVVINSGIYSEGPPKPVRDPKLLKFVDTTEMTKGPQDMPGHWLVTGAKLYLDKGKISLRVKYSLLTVSSD

SEQ ID NO: 251 - protein, 640 aa, Asplenium australasicum
MASAVGRFAATQAQSSEAAQPQITSSPAFSIAQQAVDALGRGYDVNFDLRLGYCKQRKHLIENDELGPTQDLLLPGNISIPNLPASIKCDKGDRTRFTTEILTFNEMSEQFNQDLSISGKIPTGHFNTMFNFSGSWQKDASQVKTLALDGFFINLYTVELPRAQLTLKEEVRAAVPSSWDPAALASFVEKYGTHVIVGVKIGGKDVICLRQHHSSQLSAVGVQKILEAKAKERFTSIAGGTSRENNKGKIRDGFTYGSNAMIAVNGSKDGVHPSWLNSSLSDLPPVETDDVKVMFKRKGGKAVSQSHEEWLHTVPSSPDIVSMSFVPITSLLNGVTGTGFLSHAINHYLRYKPPIDQLRHFLEFQLPKDWAPAFGDLPLGPPRKQQASPSLQFRLMGPKLQVNTMPVVVGKRCVTGIRLHLEGKKSNRLAIHLQYLTAVPQILQGLWEDHRPDNWEGPDTDFSRYFEPVMWRSFSHVCTAPVESKEPWVDEMKGEPVLKGALVVTGAQLDVQQHGSKKVLFLRLLYSKIRKVRIRRSEWDHTPASQQRSGIFSTLISTHFSSAPSPLSKPVQVNSAIYPDGPPLANSQAPKLLKFVDTSAMTRGPLDLPGHWLVTGAKLDVERGKIAVRAKYSLLLYGAD

SEQ ID NO: 252 - protein, 412 aa, Waldsteinia ternata
MALPAYRMDPQAAAEKAVAAIGSGYDLCLDLRLTSCKSGLVDLDPTRTRDLVLPGGAVVSDVSTSIKCDKGERTKFRSDVVSFNQMSEQYNKELSLSGKIPSGLFNAMFNYSGCWQKDAAPTKYLAFDGWLITLYSIELARSQLRLSEQVKRDVPSLWDPAALAAFIEKYGTHIIVGVKMGGKDIVHIKQLQNSKLEPAELQRRLKQVAEERFSDDANETSASNPTADLFGMMKDDNPLHWDIQRTLASSIKPPIVTHSMDDDVVTISVRRGGVDIGQSHNQWLSTISQAPNVISMSFVPITSLLGGTQGNGFLIHAVNLYLRYKPPIEELQQFLEFQLPRQWAPVYADLPLGLKRRRHASPSLQFSFMGPKLYVNTVKVICCAVKSGHAVDQLRKFSCLWNFHCRNGNCGE

SEQ ID NO: 253 - protein, 534 aa, Aglaomorpha (Roberts)
MSEQFNQNLAMSGKIPVGHFNSMFGFSGSWQRDASAVKTLAMDGVFITLYSVELPRAQLTLKEEVKAAVPSSWDPAALASFLEKYGTHVIVGVKIGGKDVICLKQHRTSSMSAVGVQKILEAKGKERFSSIEGSAAKEKINKGKIRDGSPFGSNGMNAVNGSKDLPWMSDSSTEYSTVETDDVTVIFKRKGGRDLSQSHEEWLRTVPSFPDIVSMSFVPITSLLNGVTGTGFLNHAINHYLRYKPPIQELHHFLEFQLPKEWAPAFGDLPLGPPRKQAGSPSLQFRLMGPKLQVNTTPVVIGKRCVTGLRLHLEGKKSNRLAIHLQYLTVVPQILQQLWQDDQPEEWEGPDDDFSKYFEPVMWKSFSHVCTAPVESTETWEDEGKGGPGSKGAQVVTGAQLDVLHCGSKKVLFLKLLYSRIHKTKIRRSEWDHTSASQQKSGIFSTLMSTTFSSAQAAPQKPVQVVVNSAIYPQGPPAANSQAPKLLKFVDTSEMTRGPLDLPGHWLVTGAKLFVDRGKIAVRAKYSLLLYSVD

SEQ ID NO: 254 - protein, 432 aa, Phormium (Lancer Terra Cotta)
MRPTDLMTPEAAAAAAVSAVGYGYDLVGDLRLSSCKAGPSGSRLIKIDDALVHDLVLPGGVVVPNVPKEIRCDKGERTRFRSDVLGFHQMAEQFNQDLSLSGKIPSGLFNAMFDFRGCWQKDLSSTKSLAFDGWFITLYSIELAKSHIVLQDKIKQEIPSSWDPVALAEFIEKYGTHIIVGIKMGGKDAVSIKQLQESALQQTEVQNLLKNLADDAFSEDFNANILLGAAEISKRLKGIKLANQENNAAVLKSMNSSIVTHLKKDDIVSIHVRRGGINTKQSHNQWLSTISQAPNVISMSFVPITSLLTGVRGSGFLSHAVNLYLRYKPPIEELHHFLEFQLPRQWAPVFNEIPLGPQHRKRRRLPSLQFTLMGPRLHVNTDKVTSSCLEDAYSQYIGSPLVSPRITKAVFQMTNDIIVQVILIMELLFFAN

SEQ ID NO: 255 - protein, 391 aa, Pteris cretica (roweri)
MSSMAIARETARSSALAVVESLGCGFDLTSDYRLKYRKGPLLELQHNSTKDLTIPGGITIPDVSRDIKWDKGERTRFASEVMQFQQMSQWFNQNASVEGKVPLGLFNAMFDLSGSWQDDASQIKNLAFDGCFITLYKLHLTRSNLVLREDVKNDIPSVWDPQGLARFIEKYGTHLIVSANVGGQDVLYLKENQASLLPSQDLHKQLKAAADDYFSDKVGERNQNFKDSETFPLNGLKDQSSAAVIAHLHSPQLLISNKDFTIISQRRGGHYACKTHLEWQETVNVFPEAISLSFVPITSLLLGVAGSGFLQHAINLYLRYKPPVGDIQYFLDFQVPRQWIPSHNELPLRLARKQAFSPSLQFRFIGPKLYINNNEVVVDRKPVTGHYNSGS

SEQ ID NO: 256 - protein, 603 aa, Hedera helix (Galaxy)
MALKLPAPEAAKIAIQSIGCGYDISLDLRLKYCKRDSTNPRLIEIHEDQGKEIVLPGGILIPNVSKAIKCDKGERTRFRSDVLSFQQMSEQFNQEMSLTGKIPSGVFNAMFEFTGSWQKDAAHTKTLAFDGLFITLYTVALDKSQMVLSDHVKKDVPSSWDPAALARFIKKYGTHIIVGVKMGGKDVIYMKQQHSSSLQPSDVQKWLKTIADKRFVDASGQYGMDSEQTYQNDKFQIREQRLRFADISPSSSYSYKEDIVSICKRRGGSDNKNLTHNEWLHSVQLEPDVISMSFIPITSLLNGVSGSGFLSHAINIYLRYKPPVEELHQFFEFQLPRQWAPVFSDLPLGPQRRQQSTSSLQFSFMGPKLYVNTTPVNVGKRPVTGLRLYLEGKRSNRLAMHMQHLSSLPKIFQLEDDPNGNFRQESYDRRYYEKVQWKYFSHICTAPVESDEDLSIVTGAQLEVGDYGFKRVLFLRLRFSTVIGAVAVKHPEWDGSPGLARKSGLISTLISHHFTAAQKPPPQPADVNINSAIYPGGPPGPAKAPKLLKFVDTTEMTRGPQDSPGYWVVSGARLMVENGRISLRVKYSLLAVILPDEEQPEES

SEQ ID NO: 257 - protein, 639 aa, Blechnum brasiliense
MASAVGGLAAMQAQSSEGAPLQNTASLAFSVAQQAVDALGRGYDVNSDLWLRYCKRGERLIENDNSGPTQDLLLPGNIIIPNVSTSIKCDKGDRMRFTSDVLTFSEMSEQFNQNLSISGKIPVGHFNAMFGFSGSWQKDASQVKTLAMDGVFINLYSVELPRAQLTLKEEVRAAVPSSWDPAALASFLEKYGTHVIVGVKIGGKDMICLKQHRSSTLPAVGVQKILEAKAKERFSSVEGSAAKEKINKGKIRDGSAHEANGMNAVFGSKDGMPLSWMNDTAPDLENDDVTVICKRKGGKDISQSHDEWLDTVPSTPDIVSMSFVPITSLLNGVTGTGFLTHAINHYLRYKPPIQELHHFLEFQLPKEWAPAFGDLPLGPPRKQQGSPSLQFRLMGPKLQVNTTPVVIGKRCVTGLRLHLEGKKSNRLALHLQYLTVVPQILQRLWEDDQAEEWEGPDDDFGKYFEPVMWKSFSHVCTAPVESNEIWVDEAKGEHGPKGALVVTGAQLDVEQHGSKKVLFLRLLYSKIHKAKIRRSEWDHTPASQQKSGIFSSLMSTTFTAQAAPVKPAHVDINSAIYPQGPPPAKSQAPKLLKYVDTTEMTRGPLDLPGHWLVTGAKLFVDRGKIAVRAKYSLLLYSVD

SEQ ID NO: 258 - protein, 596 aa, Sphaeropteris cooperi
MGSEAAARKVALDAVQSLGRGFDVTADFRTKFCKKRLVHIVNDGLESLTLPGDITIDAPSVIKCDKGECTRHTSDLMQFQQMSQAFNKRALIDGKIPLGHFNAMYDFTGSWFEDAMQTKNLAFDGKFITLFQLQLTSSLLLRKEVKNAVPSAWEPAALARFISLYGTHIVVRVSVGGQDVLYLKENASSMMSSADVHKLLKEFGDQMFAKKGGQKMQDGNHLSRRSIAPDETMYVDGTKSLFKNKDVTIFTKMRGGLLSAKTPTQWQATVTSTPDVIMMSFVPITSLLSGTPGSGFLNHAINLYLRYKPPIEDIRCFLEFQVPRQWAPVYSDLPLGPPQRAITLPSLQFCLMGPRLYVNTAQISVGRKPVTGLRLYLEGRQNNRLAIHLQHLASLPRVLEPYWNPEIHEQSNWHGSDNVESSEWFEHVQCRTFSHVCTARVKYNPVWTRSKSGVFVVTGAQLEVKSYGLKNVLHLRLQFSRIPGCTILKSRWYQPCSSNLSEKSRFFSTLSTAFTSHMVKKPVQPSPVVVDSGVFLGEPPIPIQQPKLLRFVDTRELTKGPQDMPGHWLVIGAQLDVDGGKISLNAKYSLLNFDFK

SEQ ID NO: 259 - protein, 603 aa, Tupidanthus calyptratus
MALKLPAPEAAKIAIQSIGCGYDICLDLRLKYRKRDSTNLSLIEIHEDQEKEIVLPGGILIPNVSKAIKCDKGEHARFRSDVLSFQQMSEQFNQEMSLTGKIPSGVFNTMFEFTGSWQKDAAHTKTLAFDGLFITLYTVALDKSQMVLSDHVKKAVPSSWDPAALARFIEKFGTHIIVGVKMGGKDVIYMKQQHSSSLQPSDVQKRLKTIADKRFVDASGQYGMDSEQTHQNDKFQIREQRLRFADTSPSSSYSYKEDIVIICKRRGGSDNKNLTHNEWLHNVQLEPDVISMSFIPITSLLNGVSGSGFLSHAINLYLRYKPPVEELHQFLEFQLPRQWAPVFSDLPLGPQRRQQSTSSLQFSLMGPKLYVNTTPVDVGKRPVTGLRLYLEGKRSNRLAMHMQHLSSLPKVFQLKDDPNGNFRQESYDHRYYEKVQWKNFSHICTAPVESDEDLSIVTGAQLEVGDYGFKRVLFLRLRFSTVLGAVAVKHPEWDGSPGLARKSGLISTLISHHFTATLKPPPQPADVNINSAIYPGGPPAPTQSAKLLKFVDTTEMTRGPQETPGYWVVSGARLMVEKGRISLRVKYSLLTVILPDEEALEEP

SEQ ID NO: 260 - protein, 597 aa, Tupidanthus calyptratus
MALKVSAPEAAKIAIQSIGCGYDISLDLRLKCCKGDPANPRLIEIHEDQGREIVLPGGIVIPNVSKAIKCDKGEHARFRSDVLSFQQMSEQFNQEMSLTGKIPSGVFNTMFEFTGSWQKDAANTKTLAFDGVFITLYTVALEKTQMILSDHVKQAVPSSWDPAALARFIEKFGTHIIVGVKMGGKDVIYMKQQHSSSLQPSDVQKRLKTIADKRFVDASGQYGMDSEQTHQNDKFQIREQRLRFADTSPSSSYSYKEDIVIICKRRGGSDNKNLTHNEWLHNVQLEPDVISMSFIPITSLLNGVSGSGFLSHAINLYLRYKPPVEELHQFLEFQLPRQWAPVFSDLPLGPQRRQQSTSSLQFSLMGPKLYVNTTPVDVGKRPVTGLRLYLEGKRSNRLAMHMQHLSSLPKVFQLKDDPNGNFRQESYDRRYYEKVQWKNFSHICTAPVESDEDLSIVTGAQLEVGDYGFKRVLFLRLRFSTVLGAVAVKHPEWDGSPGLARKSGLISTLISHHFTATLKPPPQPADVNINSAVYPGDPPGPAQAPKLLKFVDTTEMTRGPQDSPGYWVVSGARLMVEKGRISLRVKYSLLAAILPDE

SEQ ID NO: 261 - protein, 635 aa, Adiantum pedatum
MHPQSSELATSLPPSNSRAFSVAHQAVEALGRGYDVTCDLWLSYCKRGERLIANDNRSSTQDLYLPGNIIIPNVATSVKCDKGDRTRMTTDVLTFNEMSERFNQDLAISGKIPLGHFNAMFNLSGSWQKDASSVKSLSMNGVFINLYSVELPRTQLTLKEEVRAAVPSSWDPTALASFVEKYGTHVIVGVKIGGKDVICIKQHSTSSLSAVGVQKILEAKSKERFLSVDGNMSREKMNKGKIRDGSVLGANGTNAYRDAHKSGAPLPWMNDSSADSTIETDEVTVIFKRKGGWDSSQSHDEWLQTVPSAPDIVSMSFVPITSLLNGVTGTGFLSHAINLYLRYKPTIQELHHFLEFQLPKEWAPAYGDFPLGPPRKQHGSPSLQFRPLGPKLQVNTTPVVVGKRCVTGARLHLEGKKGNRLAIHLQYLTVVPKLLQQTWEDDQPEVWEGPDSNFAKYFEPVMWKSFSHVCTAPVESTEIWDDDGKGEQGGPRGALVVTGAQLDVQQHGSKKVLFLKVLYSKIQGASIRRSEWDHTPASQQRSGIFSTLISTPFSSPQATPLKPVQVVVNSAIYPQGPPPTNSQAPKLLKFVDSTEMTRGPVDSPGHWLVTGAKLFVDRGKIAVRVKYSLLLYSME

SEQ ID NO: 262 - protein, 353 aa, Platycerium wandae
MASKLDIPNAAKVAHLAIQSLGRGYDLTCDLRFSSFKDRNGTSLIELRNDETVKLSLPGGVVIADVPAIMKCDKGERTRFQSDILTFEQMCQQFNQGLSLSGKVPCGLFNNVFNFTGSWQKDASTTKHLALDGWFYTLYTIEMPRSQLVLKENIKSSVPTYWEPAALARFIETFGTHIIVGVQIGGKDVVYMKQHQTSPSTPIEFQKLLTEVSNERFLQTEGRASIGSKDSRSNKKRNVEFQSWSAHLDTFSQMIYNEKHHVTIIPRRKGGFDHGQSHSEWIHTVPLAPDVISVSLIPITFLLHGVAGSGFLSHAVNLYLRFFLQIIHLLKSCASFWNFSSPVHGPQFTVNCL

SEQ ID NO: 263 - protein, 296 aa, Platycerium bifurcatum
MASAKEAAALAAVEALGCGFDLTSDYRLKYKKGSLLELQHSHNKDLTIPGCITIPDVSRGIKCDKGEHMRFTSEVMQFQQMSQWFNQNASVEGKIPLGLFNAMFDLSGSWQDDANRLKNLAFDGCFITLYKLHLTRSNLVLREEVKNDIPSVWDPKSLAKFIEKYGTHIIVSASVGGQDVLYLKENYSSLISAQEIRKKLKSAGDEYFSETSGKRNADFKHSETSPLNSQPFRGTIAGSAQLLISNKDYTLISQRRGGYYFAKTHCEWQRTTSHFQQGLYSDFSKARRILFCEDPL

SEQ ID NO: 264 - protein, 601 aa, Lygodium flexuosum
MSRGSTATNTGGRYVNPWGYPAIEALGCGFDVTANYRLKYCKCPVVQLPQTLVEDMLIPGGITILNVPRDITCDKGEMVRFTSEVMEFQQMSQWFNKNSSIEGKIPLGYFNAMFDLSGSWPDDATQTKSLAFDGFFITLYKLQLSRINLVLREEVLSDIPSTWDPKSLAQFIEKYGTHVIVAVNIGGQDVLYLKENRSSSLSAKEIQQHLKLAGDSCFTDGGNNRTLVSKENEMYSLTSQASVAMHSAQLFITNKDVTIIGRRRGGNPLSKSHNEWQDTVSSSPDAISMSFVPITSLITGVSGSGFLQHAINLYLRYKPPIEDLRHFLDFQVPRQWIPEYSELPLGLLRMRGITPSLQFSLLGPRLYVNTTEVTVSRKPVTGIRLYLEGKRSNRLAIHLQHLSVLPRTLDQFWNEEIHIEQPKWHGSDGSDKKWFEPVQWKSFSHVCIEPIKFQPEWQNGKDGVFVVTGAKLEVKSYGLKSILHLRLLFTKIPGCMIQASRWDQPPASQKSNFFSSLTSTFSSTTKAVKRGSPAVLVDSAVYPGGPPKPVQSSKLLKFVDTTELTRGPQDIPGHWIVTAAKLELDCQKISLRVKYSLLNFM

SEQ ID NO: 265 - protein, 600 aa, Vernonia noveboracensis
MSQKLVENAIDSLGKGFDLTSDFRLKYCKGKERLVLLNENRSKELLVPGFGSFKEVSPDIKCDKGDRVRFQSDILDFNQMSEFFNKKCSVPGKIPTGLFNSMFGFQSGSWATDAANTKSLGLDGYFIMLFNVHLDRYPLVLSDEVLNAVPSTWDPPALARFIEKYGTHVVVGLGIGGRDVILLKQSKSSKLDSSQLKKHLEDLGDQLFNGSCTFSPHQLKTKEHKNKTPSAFNTIFDPEPMLFNGFSSTTQKDGLTIMCSKRGGDLTSTTHCEWLLTVPSMPDAINFDFIPITSLLPGVPGKGFLSHAINLYLRYKPPIADLEYFLDFQAHKIWAPVHNDLSLGPTTNRAIRDTSLNFNLMGPKLYVNTTQVTITKKPVTGMRLYLEGMKSNRLAIHLQHLSETPVLFRDKLGEALHWRGSEEIEDPRFFEPIQWKKFSHVCTASVKYNPEWSVPGKEASFIVTGAQLHVKKHNSKSVLHLRLLYSRVSSSCVVQSSWTLGPLNQSQRSGFLSAISTTLSVNGNPEKELKSSDVVVDSGIYPKGPPVEVPTPKLLKFVDMTQVCKGPRDNPGHWLVTGAKLDLTKGKIRLLVKFSLLNIC

SEQ ID NO: 266 - protein, 601 aa, Tupidanthus calyptratus
MALKLPAPEAAKIAIQSIGCGYDICLDLRLKYRKRDSTNLSLIEIHEDQEKEIVLPGGILIPNVSKAIKCDKGEHARFRSDVLSFQQMSEQFNQEMSLTGKIPSGVFNTMFEFTGSWQKDAAHTKTLAFDGLFITLYTVALDKSQMVLSDHVKKAVPSSWDPAALARFIEKFGTHIIVGVKMGGKDVIYMKQQHSSSLQPSDVQKRLKTIADKRFVDASGQYGMDSEQTHQNDKFQIREQRLRFADTSPSSSYSYKEDIVIICKRRGGSDNKNLTHNEWLHNVQLEPDVISMSFIPITSLLNGVSGSGFLSHAINLYLRYKPPVEELHQFLEFQLPRQWAPVFSDLPLGPQRRQQSTSSLQFSLMGPKLYVNTTPVDVGKRPVTGLRLYLEGKRSNRLAMHMQHLSSLPKVFQLKDDPNGNFRQESYDRRYYEKVQWKNFSHICTAPVESDEDLSIVTGAQLEVGDYGFKRVLFLRLRFSTVLGAVAVKHPEWDGSPGLARKSGLISTLISHHFTATLKPPPQPADVNINSAIYPGGPPAPTQSAKLLKFVDTTEMTRGPQETPGYWVVAGARLMVEKGRISLRVKYSLLTVMLPDEEALE

SEQ ID NO: 267 - protein, 608 aa, Platycerium wandae
MASKLDIPNAAKVAHLAIQSLGRGYDLTCDLRFSSFKDRNGTSLIQLRNDETIKLSLPGGVIVADVPAIVKCDKGERTRFQSDILSFDQMCQQFNQGLSLSGKVPCGLFNNMFNFSGSWQKDASTTKHLALDGWFYTLYTVEMPRSKLVLKENIKSLVPTSWEPAALARFIETFGTHIIVGVKIGGKDVVYMRQHQSSPSTPIEFQKLLTEVSNERFLQTEGRASMGSKDSRSHKKRNIEFQSWSAHLDTFSQMIYNEKHHITIIPRRKGGFDHGQSHSEWIHTVPLTPDVISVSLIPITFLLHGVAGSGFLSHAVNLYLRYNPPIEELRQFLEFQLPRVWAPVYGELPLTLPRREPSLPTLQFSLMGPKLKVSKLEVAVGKKPVTGLRLFLEGKRCNKLAIHLQHLSAIPKFLQPLWENHPFAREVTWQDPDDYSTKYFEPVQWKNFSHVCTAPVENTETWIGDHAGASVVVGAQLAVKSFGLRNVLYLRLLYSKIPEAKIRRSEWDHMPALTQKSGMFSSFLSTTFSSTPAPPKVPAVVINSGIYSEGPPNPVRDPKLLKFVDTTEMTKGPQDMPGHWLVTGAKLYLDKRKISLRVKYSLLTVNSD

SEQ ID NO: 268 - protein, 559 aa, Asplenium prolongatum x Asplenium antiquum (Kurata)
MPASIKCDKGERTRFTTEVLTFNEMSEQFNQDLSISGKIPTGHFNNMFDFSGSWQKDASQVKTLALDGFFINLYTVELPRAQLTLKEEVRAAVPSSWDPVALASFVEKYGTHVIVGVKIGGKDVICLRQHHSSQLSAVGVQKILEAKAKERFTYIVGGTSKEKINKGKIRDGFSYGSDVMNAVNGSKDGLSLSWMNDSLSDLLTVETADVKVMFKRKGGKDVSQSHEEWLHTVPAAPDIVSMSFVPITSLLNGVTGTGFLSHAINHYLRYKPPIDQFRHFLEFQLPKDWAPAFGDLPLGPPRKQQASPSLQFRLMGPKLQVNTTPVMVGKRCVTGVRLHLEGKKSNRLAIHLQYLTVVPQILQSRWEDDQLENWEGPDTDFSKYFEPVLWRSFSHVCTAPVESKEPWVDEMRGEPVLKGALVVTGAQLDVEQHGSKKVLFLRLLYSKIHKAASRRSEWEHTPASSQRSGIFSTLMSTPFSSAASSPTKPVHVNSAIYPDGPPPANSQAPKLLKFVDTSEMTRGPLDLPGHWLVTGAKLCVERGKIAVRAKYSLLLYSED

SEQ ID NO: 269 - protein, 598 aa, Verbascum chaixii (Vill)
MALKLPAEEAAKVAIHSIGRGYDISLDLRLKYCKGDSSLIEIDEDHSREIVLPGGITIPNVSKSIKCDKGERTRFRSDVLTFQQMSEQLNQELALTGKIPSGLFNAMFEFSGCWQKDAAYTKTLSFDGMFITLYTVALEKSHMVLRDHVKKEVPSSWDPASLARFINKFGTHVIVGLKMGGKDVIYMKQQHSSSLQSADVQKRLKAMADKRFLDANEQSELNSEQLYQSGKFEMKESRLRFADTGTSSSYSHKDDIVSICKRRGGIDGRNLNHNEWLQTVQLEPDVISMSFIPITSLLNGVSGSGYLSHAINLYLRYKPPIEELHQFLEFQLPRQWAPVFSDLPLGPQRRQQSTASLQFSLLGPKLFVNTSAVDVGKRPVTGLRLYLEGRRSNRLAIHLQHLSSLPNIFQLEDDPNGNFPQESHDRRYYEKVQWKNFSHVCTAPVESDEELSIVTGAQLHVGDYGFKKVLFLRLRFSSVIGAVSVKYPEWDGSPGLARKSGLISTLISHHFTAVQKPPPHLADVNINSAVYPGGPPVPIQTSKLLKFVDTTEMTRGPQDPPGYWVVSGARLVVEKGRISIRVKYSLLTVVQPDDDVSE

SEQ ID NO: 270 - protein, 640 aa, Bolbitis cladorrhizans
MASSGGRLAALHPQSSEAAPRQNMSSLALSVAEHAVDALGRGYDVNSDLWLRSKHCECLIEDDKSGATQNLHLPGNIVIPNVPASVKCDKGDRTRFTSDILSFNEMSEQFNQTLSISGKIPVGHFNAMFNFTGSWQKDASQFKALAMDGVFINLYSVELPRTQLTLKEEVRAAVPSSWDPAALASFVEKYGTHVIVGVKIGGKDVICLKQHRSSSLSTVGVQKILESQAKERFSSVDSRAGKEKINKGKIRDGGSPFGSNGINAVHGLKDLSLISNSSSDSSKVETDDVIMIFTRKAGRNVSASHEEWLHTVASAPDIVSMSFVPITSLLNGVTGTGFLSHAINHYLRYKPPIQELRHFLEFQLPKEWAPAFGDLPLGPPRKQQASPSLQFRPMGPKLQVNTTPVVIGKRCVTGLRLHLEGKKGNRLAVHLQYLTVVPQILQRLWDDDQPEEWEGPDDDFSKYFEPVMWKSFSHVCTAPVEGNDTWEDEGKGEPGPKGALVVTGARLDVEHCGSKKVLFLRLLYSKIHKAKIRRSEWDDTPASQQKSGIFSTLMSTTFSSAQSAPQKPVQVVVNSAIYPEGPPPAKSQVPKLLKFVDTTEMTRGPLNLPGHWLVTGAKLFVDRGKITVRAKYSLLLYIVD

SEQ ID NO: 271 - protein, 646 aa, Platycerium wandae
MASAKEAAALAAVEALGCGFDLTSDYRLKYKKGSLLELQHSHNKDLTIPGCITIPDVSRGIKCDKGEHMRFTSEVMQFQQMSQWFNQNASVEGKIPLGLFNAMFDLSGSWQDDANRLKNLAFDGCFITLYKLHLTRSNLVLREEVKNDIPSVWDPKSLAKFIEKYGTHIIVSASVGGQDVLYLKENYSSLISAQEIRKKLKSAGDEYFSETSGKRNADFKHSETSPLNSQPFRGTIAGSAQLLISNKDYTLISQSAGDEYFSETSGKRNADFKHSETSPLNSQPFRGTIAGSAQLLISNKDYTLISQRRGGYYFAKTHCEWQETVNMYPEAISLSFIPITSLLLGAVGSGFLQHAINLYLRYKPPVSDLQYFLDYQVPRQWIPVHNELPLRLARKQAFSPSLQFSLMSPKLYIDNNEVVVSRKPVTGIRLYLEGRKNNRLAIHLQHLSVLPQSLGKFWSEGIQIEAPLWNGSSDAPNEWFEPVEWKCFSHVCTQPIKYKPEWSNEQGSAFVVTGAQLGVKAHGLKSVLHLHLLFSKIPGCSIQRSRWDQHPAAEKTGFFSSISTTFSTTTKAGKKGPPVVVDSAVYMGGPPRPIQSPKLLKFVDTAELTKGPQDAPGHWVVTAARLELDKGKIAIKVKFSLLNYAE

SEQ ID NO: 272 - protein, 317 aa, Tupidanthus calyptratus
MEGGEETVKPIGLRAMESLGLGFDFASDFRLKFAKRCPGAGGDDRLVVLDEASRRDVVFPGGGVIRGVPECIRCDKGDRIRFKSDVLKFNQMSELVNQKSSVQGKVPSGYFNAMFDLSGSWLNDAADANHLAFDGYFITLYCLHLTASPLVLRDKVKKSVPSHWNPASLSRFILTYGTHIIVGLAVGGQDVICVKQRPSSGIPPAELRGYLEDLGDCMFSDGRNPVLERKTRDGKQKVPEVFNRMLQSHTMQFSSITETSSKDGLTILSSKRGGDVFSQNHSNWLQTVASNPEAICFKLVPITSLLTGVPAVSALKS

SEQ ID NO: 273 - protein, 328 aa, Tupidanthus calyptratus
MEGGEETVKPIGLRAMESLGLGFDFASDFRLKFAKRCPGAGGDDRLVVLDEASRRDVVFPGGGVIRGVPECIRCDKGDRIRFKSDVLKFNQMSELVNQKSSVQGKVPSGYFNAMFDLSGSWFNDAADSNHLAFDGYFISLYYLHLIASPLVLRDKVKNSVPSHWNPASLSRFILTYGTHIIVGLAVGGQDVICVKQRPSSGIPPAELRGYLEDLGDCMFSDGRNPVLERKTRDGKQKVPEVFNRMLQSHTMQFSSITETSSKDGLTILSSKRGGDVFSQNHSNWLQTVASNPEAICFKLVPITSLLTGVPGSGYLSHAINLYLRCKCP

SEQ ID NO: 274 - protein, 392 aa, Verbascum chaixii (Vill)
MSDEIVKSALASLGKGFDLSSDFRLKYCKGDERLIMLNETHTRELKIPSFGSFNNVSIDIKCDKGDRTRYQSDILDFNQMSELFNHKCSIPGKIPSGRFNSMFGFQSGSWANDAGNTKYLGLDGYFIVLFDVHIDRYPLILADEVRNDVPSTWDPSALARFIEKYGTHIIVGISIGGEDVVLVKQDKSSNMEPSQLKNHLDNLGDQLFNGACTFPPHQFKNKEQKYKAPEAFNVFDPQPNIFSNFATITAKDGISVICSKMGGDTTVSTHCEWLLTVPSKPDAIHFNFIPITSLLRGIPGKGFLSHAINLYLRYKPPIADLKYFLDFQAHRIWAPIHNDLPLGPIRSKALQTPALHFNMMGPKLYVNTSQVTVGNTPVTGMRLYLEGMKCNR

SEQ ID NO: 275 - protein, 369 aa, Sphaeropteris cooperi
MGSEAAARKVALDAVQSLGRGFDVTADFRTKFCKKRLVHIVNDGLESLTLPGDITIDAPSVIKCDKGECTRHTSDLMQFQQMSQAFNKRALIDGKIPLGHFNAMYDFTGSWFEDAMQTKNLAFDGKFITLFQLQLTSSLLLRKEVKNAVPSAWEPAALARFISLYGTHIVVRVSVGGQDVLYLKENASSMMSSADVHKHLKNLGDQMFAEKGVQKIQDGNSLRGCSIAPVEIDGTNILYKSKDLTIIAKKRGGRLCAKTPSEWQATVMSAPDVIMMSFVPITALLSGTPGSGFLNHAINLYLRYKPPIEDIRCFLEFQVPRQWAPVYSDLPLGPPQRAITLPSLQFCLMGPRLYVNTAQGSLSLDYASI

SEQ ID NO: 276 - protein, 404 aa, Sphaeropteris cooperi
MMSSADVHKHLKNLGDQMFAEKGVQKIQDGNSLRGCSIAPVEIDGTNILYKSKDLTIIAKKRGGRLCAKTPSEWQATVMSAPDVIMMSFVPITALLSGTPGSGFLNHAINLYLRYKPPIEDIRCFLEFQVPRQWAPVYSDLPLGPPQRAITLPSLQFCLMGPRLYVNTAQISVGRKPVTGLRLYLEGRQNNRLAIHLQHLASLPRVLEPYWNPEIHEQSNWHGSDNVESSEWFEHVQCRTFSHVCTARVKYNPVWTRSKSGVFVVTGAQLEVKSYGLKNVLHLRLQFSRIPGCTILKSRWYQPCSSNLSEKSRFFSTLSTAFTSHMVKKPVQPSPVVVDSGVFLGEPPIPIQQPKLLRFVDTRELTKGPQDMPGHWLVIGAQLDVDGGKISLNAKYSLLNFDFK

SEQ ID NO: 277 - protein, 638 aa, Asplenium australasicum
MASAVGRFAATQAQSSEAAQPQITSSPAFSIAQQAVDALGRGYDVNFDLRLGYCKQRKHLIENDELGPTQDLLLPGNISIPNLPASIKCDKGDRTRFTTEILTFNEMSEQFNQDLSISGKIPTGHFNTMFNFSGSWQKDASQVKTLALDGFFINLYTVELPRAQLTLKEEVRAAVPTSWDPAALASFVKKYGTHVIVGVKIGGKDVVCLKQHHTSQLSTIRVQKILEEKAKERFTPIAGGTSKEKINKGKIRDGSPYGSNAMNGSKDGLSLSWMNDSLSDLLTVETDDVRVMFKRKGGKDVSQSHEEWLHTVPSSPDIVSMSFVPITSLLNGVTGTGFLSHAINHYLRYKPPIDQLRHFLEFQLPKDWAPAFGDLPLGPPRKQQASPSLQFRLMGPKLQVNTMPVVVGKRCVTGIRLHLEGKKSNRLAIHLQYLTAVPQILQGLWEDHRPDNWEGPDTDFSRYFEPVMWRSFSHVCTAPVESKEPWVDEMKGEPVLKGALVVTGAQLDVQQHGSKKVLFLRLLYSKIRKVRIRRSEWDHTPASQQRSGIFSTLISTHFSSAPSPLSKPVQVNSAIYPDGPPLANSQAPKLLKFVDTSAMTRGPLDLPGHWLVTGAKLCVERGKIAVRAKYSLLLYSED

SEQ ID NO: 278 - protein, 390 aa, Aglaomorpha (Roberts)
MASKLDIPNAATVAHLAIQSLGRGYDLTCDLRFSSFKDVNGASLIELRDSETIELSLPGGVVVANVPAIVKCDKGERTRFRSDILAFEQMSQQFNQGLSLSGKIPCGLFNNMFNFTGSWQKNSSNTKHLALDGWFYTLYNMEMPRSQLVLKEDIKASVPSSWEPVALARFIETFGTHIVVGVKVGGKDVVYMKQHQSSPSTSIEFQKLLAEVSDERFLRSEGRASVGSKDSRSNKKHNIEFQPWSAHLDTFSQMSYNEKHHVTIIPRRKGGFDHGQSHSEWIHTVPLAPDIISVSLIPITFLLHGVAGSGFLSHASNLYLRYKPPIEELRQFLEFQLPREWAPVYSELPLTLPRREPSLSTLQFTFMGPKLKVSKLEKCLLCRLQLGKSL

SEQ ID NO: 279 - protein, 368 aa, Tupidanthus calyptratus
MFSDGRNPVLERKTRDGKQKVPEVFNRMLQSHTMQFSSITETSSKDGLTILSSKRGGDVFSQSHSKWLQTVASNPEAISFKLVPITSLLTGVRGSGYLSHAINLYLRYKPIPEDLQYFLEFQVPRQWAPLFCEMPLGHQRRKASCPPLQFSFMGPKTRISSTLVTSGQKPVVGLRLFLEGKKCNHLAIHVQHLSSLPNIMAFACANSTISKPSQWRGSDDYESSDQFLEPVRWKRYSNVCSSVVKHDPNWIQGEEPGGAFIVTGAQLISKGKWPKTVLHLYLLFTYLPNCTIRKTEWAAAPETSRRSGFLTNLSTTFTFTQRDVADAPKQLPAALNSAIYPDGPPVPLSSGKLLKYVDVSEVVRGPHD

SEQ ID NO: 280 - protein, 544 aa, Matteuccia struthiopteris
MFREMSNVTKESASALPLSSYSFNRCLNGSIKMLLLKERFLLGFSMLCLICLDLGKMMQTNYRISPLMYTLSLYKLHLTRSHLVLREEVKNDIPSVWDPQSLAKFIEKYGTHIIVSASVGGQDVLYLKENYSSLLSTQDIHKKLKSAGDDYFSDRGGEKSANFKESETLPLNALSSQPFRATVAHIHSAQVLVTNKDFTIISQRRGGYHFAKTHCGWQETVNIFPEAISLSFVPITSLLVGVAGSGFLQHAINLYLRYKPPVSDIQYFLDFQVPRQWIPIHNELPLRLARKQTFSPSLQFSLTGPKLYINNNEVVVNRKPVTGIRLYLEGRKSNRLAIHLQHLSVLPQSLGQFWNEGTELESPWWNGSNDAPKEWFEPVEWKCFSHVCTQPIKYKPEWLNERGSAFVVTGARLEVKAHGLKNVLHLHLLFSKIPGCTIQRSRWGQHPAAEKTGFFSSISTTFSSTTKAGKKGPPVVVDSAVFIGGPPRPIQSPKLLKFVDTTELTKGPQDAPGHWVVTAARLELDRGKISVSVKFSLLNYADAE

SEQ ID NO: 281 - protein, 593 aa, Platycerium wandae
MASAKEAAALAAVEALGCGFDLTSDYRLKYKKGPLLELQHSHNKDLTIPGCITIPDVSRDIKCDKGEHMRFTSEVMQFQQMSQWFNQNASIEGKIPLGLFNAMFDLSGSWQDDANRVKNLAFDGCFITLYKLHLTTSNLVLQEEVKNDIPSVWDPKALAKFIEKYGTHIIVSASVGGQDVLYLKENYSSLLSAQEIRKKLKSAGDEYFSEISGKRNVDFKVNETSPLNSQPFRGTIAASAQLLISNKDYTLISQRRGGYHFAKTHCEWQDTVNMYPEAISLSFVPITSLLSGAAGSGFLQHAINLYLRYKPPVSDLQYFLDFQVPRQWIPVHNELPLRLARKQAFSPSLQFSLMSPKLYINNNEVVVNKKPVTGIRLFLEGRKNNRLAIHLQHLSVLPQSLGQFWSEGTQMEQPRWNGSNDAPNDWFEPVEWKCFSHVCTQPIKFKPEWSNEQGSAFVVTGARLDVKAHGLKSVLHLHLLFSRIPGCSIQRSRWDQHPAAEKTGFFSSISTTFSTTTKAGKKGPPVVVDSAVYMGGPPRPIQSPKLLKFVDTAELTKGPQDAPGHWVVTAARLELDKGKIAIKVKFSLLNYAE

SEQ ID NO: 282 - protein, 333 aa, Tupidanthus calyptratus
MFSDGRNPVLERKTRDGKQKVPEVFNRMLQSHTMQFSSITETSSKDGLTILSSKRGGDVFSQNHSNWLQTVASNPEAICFKLVPITSLLTGVPGSGYLSHAINLYLRYKPAPEDLRYFLEFQVPVQWAPLFCELPLRHQRRKASCPLLQFAFLGPKIHVSSTQVTSGEKPVVGLRLFLEGKKCNRMAIHAQHLSSLPNIMEFALSNSATSRPCQWRGSDDYISNDQFLEPVRWKRYSNVCSSVVEHDSNWIQGEEVGAFVVTGAQLISKGKWPKTILHLRLLFSYLPNCTIRKTEWAAAPEASQKSGFRLNLAQLSHSVSELVLMHQSSFQLH

SEQ ID NO: 283 - protein, 646 aa, Aglaomorpha (Roberts)
MASKLDIPNAATVAHLAIQSLGRGYDLTCDLRFSSFKDVNGASLIELRDSETIELSLPGGVVVANVPAIVKCDKGERTRFRSDILAFEQMSQQFNQGLSLSGKIPCGLFNNMFNFTGSWQKNSSNTKHLALDGWFYTLYNMEMPRSQLVLKEDIKASVPSSWEPVALARFIETFGTHIVVGVKVGGKDVVYMKQHQSSPSTSIEFQKLLAEVSDERFLRSEGRASVGSKDSRSNKKHNIEFQPWSAHLDTFSQMSYNEKHHVTIIPRRKGGFDHGQSHSEWIHTVPLAPDIISVSLIPITFLLHGVAGSGFLSHASNLYLRYKPPIEELRQFLEFQLPREWAPVYSELPLTLPRREPSLSTLQFTFMGPKLKVSKLEVAVGKKPVTGMRLFLEGKRCDKLAIHLQHLSAIPRFLQPLWEDHPFSREVTWQDPDDYSTKYFEPVQWKNFSHVCTAPVENTETWIGDHAGASVVVGAQLGVKSFGLRNVLYLRAPVENTETWIGDHAGASVVVGAQLGVKSFGLRNVLYLRLLYSKIPEAKIRRSEWDHMPALTQKSGMFSSFLSTTFTSTPAAPKAVVINSGIYPEGPPKPVRDPKLLKFVDTTEMTKGPQDMPGHWLVTGAKLYLDKRKISLRVKYSLLTVSSDGP

SEQ ID NO: 284 - protein, 639 aa, Blechnum cartilagineum (Sw)
MASAVGGLAAMQAQSSKGAPPQNMPSLAFQVAQQAVDALGRGYDVNSDLWLRYCKRGECLIENDNSVPTQDLLLPGNIIIPNVPTSIKCDKGDRTRFTSDVLTFSEMSEQFNQNLSISGKIPVGHFNAMFGFSGSWQKDASQVKTLAMDGVIINLYSVELPRAQLTLKEEVRAAVPSSWNPAALASFVEKYGTHVIVGVTIGGKDMICLKQHRSSSLSIVGVQKILEAKAKERFSSVEGSATKEKINKGKIRDGSTYESNGMNAVFGSKDGMPFSWMSDSVPEIENEDVTVIFKRKGGRDISLSHDKWLHTVPSAPDIVSMSFVPITSLLNGITGTGFLSHAINHYLRYKPPIQELRHFLEFQLPKEWAPAFGDLPLGPPRKQQGSPSLQFRLMGPKLQVNTTPVVIGKRCVTGLRLHLEGKKSNRLAVHLQYLTVVPQILQQLWEDDQPEEWEGPDDDVSKYFEPVMWKSFSHVCTAPVESNEIWVDEAKGEPGPKGAQVVTGAQLDVEQHGSKKVLFLRLLYSKIHKATIRRSEWDHTPASQQKSGIFSTLMSTPFSAQAAPVKPVQVVVNSAIYPQGPPPAKSQAPKLLKFVDTTEMTRGPLDLPGHWLVTGAKLFVDRGKIAVRAKYSLLLYSED

SEQ ID NO: 285 - protein, 638 aa, Asplenium australasicum
MASTVGGLAAMQAQSSEAAQPPNMSFTAFSIAQQAVDALGRGYNVNLDLSLSYCKQGKRLIEIDESGPTQDLLLPGNIIIPNMPASIKCDKGDRTRFTTEVLKFNEMSEQFNQNLSISGKIPTGHFNTMFNFSGSWQKDASQVKTLALDGFFINLYTVELPRAQLTLKEEVRAAVPTSWDPAALASFVKKYGTHVIVGVKIGGKDVVCLKQHHTSQLSTIRVQKILEEKAKERFTPIAGGTSKEKINKGKIRDGSPYGSNAMNGSKDGLSLSWMNDSLSDLLTVETDDVRVMFKRKGGKDVSQSHEEWLHTVPSSPDIVSMSFVPITSLLNGVTGTGFLSHAINHYLRYKPPIDQLRHFLEFQLPKDWAPAFGDLPLGPPRKQQASPSLQFRLMGPKLQVNTMPVVVGKRCVTGIRLHLEGKKSNRLAIHLQYLTAVPQILQGLWEDHRPDNWEGPDTDFSRYFEPVMWRSFSHVCTAPVESKEPWVDEMKGEPVLKGALVVTGAQLDVQQHGSKKVLFLRLLYSKIRKVRIRRSEWDHTPASQQRSGIFSTLISTHFSSAPSPLSKPVQVNSAIYPDGPPLANSQAPKLLKFVDTSAMTRGPLDLPGHWLVTGAKLDVERGKIAVRAKYSLLLYGAD

SEQ ID NO: 286 - protein, 339 aa, Hedera helix (Galaxy)
MSCSTSTSSGSGDGIVWRAINSMGKGFDLTSDFRLNYCKGNHTLVLLNQTHTRQLLVPGFGYFNHVSSDINCDKGDRTRYQSDILDFNQMSEFMNQRSSVPGKIPSGLFNSMFGFESESWAKEAGSTKCLGLDAYFISLFHLRINRYPLVLCDEVRNAVPSTWDPAALARFIEKYGTHIIVGLGIGGQDTVVVRQNKSSNLEASDLKKNLDQLGDQLFTGTCTFTPKHRNHKTPPAFNVFDHRSMLFDNFSSVKTKNGINVICSKRGGDVSAHTHCEWLLTVPSMPDAIQFSFIPITSLLKGVPGNGFLTHAINLYLRCRFNSSIISHYRHNFPNHNHL

SEQ ID NO: 287 - protein, 419 aa, Waldsteinia ternata
MALPAYRMDPQAAAEKAVAAIGSGYDLCLDLRLTSCKSGLVDLDPTRTRDLVLPGGAVVSDVSTSIKCDKGERTKFRSDVVSFNQMSEQYNKELSLSGKIPSGLFNAMFNYSGCWQKDAAPTKYLAFDGWLITLYSIELARSQLRLSEQVKRDVPSLWDPAALAAFIEKYGTHIIVGVKMGGKDIVHIKQLQNSKLEPAELQRRLKQVAEERFSDDANETSASNPTADLFGMMKDDNPLHWDIQRTLASSIKPPIVTHSMDDDVVTISVRRGGVDIGQSHNQWLSTISQAPNVISMSFVPITSLLGGTQGNGFLIHAVNLYLRYKPPIEELQQFLEFQLPRQWAPVYADLPLGLKRRRHASPSLQFSFMGPKLYVNTVTGMEIVGNNLMAQLLLIISMFCQSVCSSISLLVQCFVTMCF

SEQ ID NO: 288 - protein, 610 aa, Asplenium prolongatum x Asplenium antiquum (Kurata)
MASKHDIPNATKVANLAFQSLGRGYDLTCDLRFSSCKDVHGAPLIELGDKDVRKVFLPGGVVVPNVPTIVKCDKGEQTHFRSDILTFDQMSQEFNHGLSLSGKVPSGLFNYMFNFTGSWQKDASSTRHLALDGWFYTLYTLEMPRSHLALKDDIKATVPTSWEPAALARFIETFGTHIIIGAKIGGKDVVYLKQHQVSTSTLADFQKLLSEVSEERFSQTEGRASVGSKDSHSNNKRSTQFKSWTARLDTFSQIIYNDKHHVTIIPRRKGGFDRGQSHSDWVHTVPLAPDVISVSLVPITSLLNGVPGSGFLSHAVNLYLRYKPPTEELRQFLEFQLPCEWAPVFSELPLTLSRREQSPSTLQFTLMGPKLKVNKSQVTIGRRPVTGMRLFLEGKRCDRLSIHLQHLLAMPKFLISFWEDHPFASEATWQDPDDYSTKYFEPLQWKNFSHICTAPVENTETWIGDHAGASVVVGAQLAVKSFKLRNVLYLRLLYSKIPEAKIRRSEWDNVPAAAQKSGMFSSFFSTSFSSTAATIVAKAPAVVINSGVYPEGPPKPVHDPKLLKLVDTTEMTKGPQDMPGHWLVTGAKLYLDKRKISLRVKYSLLTVSLD

SEQ ID NO: 289 - protein, 634 aa, Colysis wrightii (Ching)
MASAAGGFAALQPQSSEAVSQNTPFSVAQQAIDALGRGYDVNSDLWLRYCQHSERVIESTPGPTQDLLLPGNIVIPKVSASITCDKGDRTRFTSDVLTFNEMSEQFNQNLAISGKIPVGYFNSMFGFTGSWQRDASAVKTLAMDGVFITLYSVELPRAQLTLKEEVKAAVPSSWDPAALASFLEKYGTHVIVGVKIGGKDVVCLKQHRSSSLSAVGVQKILEAKGKERFSSVEGSAAKKNLNKGKIRDGSPFGSNGMNAVNGSKDLPWMSDSSSENLVEMDDVTVIFKRKGGRELSQSHDEWLHTVPLLPDIVSMSFVPITSLLNGITGTGFLNHAINHYLRYKPPIQELHHFLEFQLPKEWAPAFGDLPLGPPRKQAGSPSLQFRLMGPKLQVNTTPVVIGKRCVTGLRLHLEGKKSNRLAIHLQYLTVVPQILQHLWQDDQPEVWEGPDDDFSKYFEPVMWKSFSHICTAPVESTETWEDEGKGGSGSKGAQVVTGAQLDVIQCGSKKVLFLKLLYSKIHKAKIRRSDWDHAPASQQKSGIFSTLMSTTFSSAQATPQKPVQVVVNSAIYPQGPPAANSQAPKLLKFVDTSEMTRGPLDLPGHWLVTGAKLFVDRGKIAVRAKYSLLLYSVD

SEQ ID NO: 290 - protein, 395 aa, Phormium (Lancer Terra Cotta)
MALKFPPRKAAEFAINSIGLGYDVAADIRLKYCKRETQDPCLIELDKDQLQDIVLPGGITVSNVPKSIKCDKGERTRFRSDVLSFQQMSEQFNQELSLSGKIPSGLFNYMFEFSNCWQKDAANTKSLAFDGWFITLYTVALAKSQIVLRDHVKQAVPSSWDPAALARFIEKFGTHVIVGVKMGGKDVIYVKQQHFSNLQPAEVQKILKDMADKRFLDVSGQYGMNSEEAFGKDKFDFKEQRLRFADSSSSSSYSTKEDIVRIFKRRGGNDNKDLPHPEWLNTVQYEPDVISMSFVPITSLLQGIPGSGFLSHAINLYLRYKPPTEELHQFLEFQLPRQWAPVFSDLPLGPQRKHQSTASLQFTFMGPKLYVNTSVVDVGKRPVTGNLFMLLTLLA

SEQ ID NO: 291 - protein, 385 aa, Phormium (Lancer Terra Cotta)
MALKFPPRKAAEFAINSIGLGYDVAADIRLKYCKRETQDPCLIELDKDQLQDIVLPGGITVSNVPKSIKCDKGERTRFRSDVLSFQQMSEQFNQELSLSGKIPSGLFNYMFEFSNCWQKDAANTKSLAFDGWFITLYTVALAKSQIVLRDHVKQAVPSSWDPAALARFIEKFGTHVIVGVKMGGKDVIYVKQQHFSNLQPAEVQKILKDMADKRFLDVSGQYGMNSEEAFGKDKFDFKEQRLRFADSSSSSSYSTKEDIVRIFKRRGGNDNKDLPHPEWLNTVQYEPDVISMSFVPITSLLQGIPGSGFLSHAINLYLRYKPPTEELHQFLEFQLPRQWAPVFSDLPLGPQRKHQSTASLQFTFMGPKLYVNTSSLTIFQLGLHA

SEQ ID NO: 292 - protein, 401 aa, Tupidanthus calyptratus
MFSDGRNPVLERKTRDGKQKVPEVFNRMLQSHTMQFSSITETSSKDGLTILSSKRGGDVFSQNHSNWLQTVASNPEAICFKLVPITSLLTGVPGSGYLSHAINLYLRYKPAPEDLRYFLEFQVPVQWAPLFCELPLRHQRRKASCPLLQFAFLGPKIHVSSTQVTSGEKPVVGLRLFLEGKKCNRMAIHAQHLSSLPNIMEFALSNSATSRPCQWRGSDDYISNDQFLEPVRWKRYSNVCSSVVEHDSNWIQGEEVGAFVVTGAQLISKGKWPKTILHLRLLFSYLPNCTIRKTEWAAAPEASQKSGFRLNLSTTFTFSQRTGADAPKQLPAALNSGVYPEGPPVPLRSKKLLKYVDVAEVVRGPHDTPGHWLVTAAKLVTDGGKIGLHVKFALLDYLPGS

SEQ ID NO: 293 - protein, 640 aa, Lygodium flexuosum
MKPAAATIRPNFYTSSSSSAPSDPASVAKQAVDALGRGYDVTGDLWLSKCREPLIVDLAESSPTQDLAIPGGISLPSVPAPIKCDKGDRTRFASDILSFSEMSEQFNKTLSIAGKIPLGLFNSMFGFTGLWQKDASSTKTLALDGVFINLYSVEVPRTHLNLREEVRKAVPSSWDPAALASFVDKYGTHVIVGVKIGGKDVIYVKQRHSSPLSAVSIQKILETKAVERFSSGETCTSKEKLTKGKDFQTKGIHGAEPNGQNGNLLRGHVDGMENSESFSLMEDSSTFSIDGDVTVIYKRKGGSESCQSHNDWLHTVPLAPDVVSMSFVPITTLLNGVPGTGFLSHAINLYLRYKPPLQELSNFLEFQLPKEWAPAFGDLPLGPPRKQQEVPSLQFRLMGPKLHINTTPVVVGKRPVTGLRLYLEGKKSNKLAIHLQYLTAVPQILKTLWVEDGGGEEEWVGPEEDFSKYFEPVQWRNFSHVCTAPVENSETWLGGPGGALVVVGARLQVQQYGAKKVLFLHLLYSRIAKARIRRSEWDHMPASQQKSGLFSTLISTTFSSAAAQSPAPPKPVVINSAIYPEGPPVPGQMPKLLKFVDTTEMTRGPHDLPGHWLVTGAKLLLERGKISLRAKYSLLLYSVE

SEQ ID NO: 294 - protein, 593 aa, Aglaomorpha (Roberts)
MASAKDAAALAAVEALGCGFDLTSDYRLKYKKGSLLELQRSHNKDLTIPGGITIPDVSRDIKCDKGERMRFASEVMQFQQMSQWFNQNASIEGKIPLGLFNAMFDLSGSWQDDASRLKSLAFDGSFITLYKLHLTRSNLVLREDVKKDIPSVWDPKSLAKFIEKYGTHIIVSASVGGQDVLYLKENDSSLLSAQDIRKKLKSAGDDYFSENSGKRNTDFKDSETLPLNSQPFRGTIAASAQLLISNKDYTVLSQRRGGYYFAKTHCEWQETVNMYPEAISLSFVPITSLVLGAAGSGFLQHAINLYLRYKPPVSDLQYFLDFQVPRQWIPVHNELPLRLARKQAFSPSLQFSLMSPKLYINNNEVVVNKKPVTGIRLYLEGRKNNRLGIHLQHLSVLPQSLGQFWSEGTQIESPQWNGSNDAPNDWFEPVEWRCFSHVCTQPIKFKSEWLNERDSAFVVTGARLDVKAHGLKSVLHLHLLFSKIPGCTIQRSRWDQHLAAEKTGFFSSISTTFSTTTKAGKKSPQVVVDSAVFMGGPPRPIQSPKLLKFVDTAELIKGPQDAPGHWVVTAARLELDRGKIAIKVKFSLLNYAE

SEQ ID NO: 295 - protein, 650 aa, Bolbitis cladorrhizans
MASSGGRLAALHPQSSEAAPRQNMSSLALSVAEHAVDALGRGYDVNSDLWLRSKHCECLIEDDKSGATQNLHLPGNIVIPNVPASVKCDKGDRTRFTSDILSFNEMSEQFNQTLSISGKIPVGHFNAMFNFTGSWQKDASQFKALAMDGVFINLYSVELPRTQLTLKEVPRTQLTLKEEVRAAVPSSWDPAALASFVEKYGTHVIVGVKIGGKDVICLKQHRSSSLSTVGVQKILESQAKERFSSVDSRAGKEKINKGKIRDGGSPFGSNGINAVHGLKDLSLISNSSSDSSKVETDDVIMIFTRKAGRNVSASHEEWLHTVASAPDIVSMSFVPITSLLNGVTGTGFLSHAINHYLRYKPPIQELRHFLEFQLPKEWAPAFGDLPLGPPRKQQASPSLQFRPMGPKLQVNTTPVVIGKRCVTGLRLHLEGKKGNRLAVHLQYLTVVPQILQRLWDDDQPEEWEGPDDDFSKYFEPVMWKSFSHVCTAPVEGNDTWEDEGKGEPGPKGALVVTGARLDVEHCGSKKVLFLRLLYSKIHKAKIRRSEWDDTPASQQKSGIFSTLMSTTFSSAQSAPQKPVQVVVNSAIYPEGPPPAKSQVPKLLKFVDTTEMTRGPLNLPGHWLVTGAKLFVDRGKITVRAKYSLLLYIVD

SEQ ID NO: 296 - protein, 307 aa, Blechnum brasiliense (Crispum)
MRFTSDVLTFSEMSEQFNQNLSISGKIPVGHFNAMFGFSGSWQKDASQVKTLAMDGVFINLYSVELPRAQLTLKEEVRAAVPSSWDPAALASFLEKYGTHVIVGVKIGGKDMICLKQHRSSTLAAVGVQKILEAKAKERFSSVEGSAAKEKINKGKIRDGSAYEANGMNAVFGSKDGMPLSWMNDTAPDLENDDVTVICKRKGGKDISQSHDEWLDTVPSAPDIVSMSFVPITSLLNGVTGTGFLTHAINHYLRYKPPIQELHHFLEFQLPKEWAPAFGDLPLGPPRKQQGSPSLAEETAGKSVAAV

SEQ ID NO: 297 - protein, 612 aa, Psilotum nudum
MAVNRPFSDSKTVAQRAIEALGKGYDVVADLRLSFCKGDLESRLIVLDETQVQELVFPGGIKIPNVPRAIKCDKGERTRFSSDVLSFHQMSEQFNQGLAISGKIPLGLFNAMFRLTGSWQSDASSTKSLAMDGWFITLYSVELPRSQVVLREEVKRAVPRSWDPAALARFINRYGTHIIVGMKIGGKDVLYLKQHQSSVRTPLEIQKILKKKAEERFAGVETNTSLDSRGIADKERTVDQPAWMDRTNQLVFGINCSVVDMKDMTILCQRRGGHDSKPNLSHCQWLHTVPSAPTVISMNFVPITSLLNGVPGSGFLNNAVNLYLRYKPPIEELYHFLEFQLSRLWAPVFNELPLGPPRKEHGPPALQFGLMRPKLYVKTSPVLVGKKPVTGLRLYLEGKKSNWLAIHLQHLATPPQILRPLWENGGELKWQGPEQFDPRYFEPVLWKSFSHVCTAPVANSKNIESCEDWHDAPAEAHIVVGAQLGVMEFSAKNILHLKLLYSRIPNVRIRRSEWDHSPATSQKSGIFSTLMSTTFSSTQTLPKPAPVIMNSGIFQGVPPVPVRVPKMLKFVDTTEMTKGPHDIPGYWLVTGAKLCLDRGKISLHVKYSLLSY

SEQ ID NO: 298 - protein, 601 aa, Tupidanthus calyptratus
MALKVSAPEAAKIAIQSIGCGYDISLDLRLKCCKGDPANPRLIEIHEDQGREIVLPGGIVIPNVSKAIKCDKGEHARFRSDVLSFQQMSEQFNQEMSLTGKIPSGVFNTMFEFTGSWQKDAAHTKTLAFDGLFITLYTVALDKSQMVLSDHVKKAVPSSWDPAALARFIEKFGTHIIVGVKMGGKDVIYMKQQHSSSLQPSDVQKRLKTIADKRFVDASGQYGMDSEQTHQNDKFQIREQRLRFADTSPSSSYSYKEDIVIICKRRGGSDNKNLTHNEWLHNVQLEPDVISMSFIPITSLLNGVSGSGFLSHAINLYLRYKPPVEELHQFLEFQLPRQWAPVFSDLPLGPQRRQQSTSSLQFSLMGPKLYVNTTPVDVGKRPVTGLRLYLEGKRSNRLAMHMQHLSSLPKVFQLKDDPNGNFRQESYDHRYYEKVQWKNFSHICTAPVESDEDLSIVTGAQLEVGDYGFKRVLFLRLRFSTVLGAVAVKHPEWDGSPGLARKSGLISTLISHHFTATLKPPPQPADVNINSAIYPGGPPAPTQSAKLLKFVDTTEMTRGPQETPGYWVVSGARLMVEKGRISLRVKYSLLTVMLPDEEALE

SEQ ID NO: 299 - protein, 609 aa, Pteris ensiformis (Evergemiensis)
MASKHEFPNAAKVAKLAVETLGRGYDLTCDLRFSSCKGADDTPLIEINTKETHELTLPGGIVVPKVPTIVNCDKGERTRFRSDILTFDQMSQEFNQGLSLSGKIPSGLFNYMFNFTGIWQKDASTTRHLALDGWFYTMYAVEIPRSQLVLKEEIKASVPESWEPAALARFIETFGTHIIVGAKIGGKDVVYMKQHQSSSSTSVEFQKLLAEVSDERFSQSERRTSAGSVENRSKRKNKIEFQSWSAHLDTASQIVYNEKHHVTILPRRKGGMDRFQNHSEWIHTVPLAPDVISVSLVPITFLLSGVAGSGFLSHAVNLYLRYKPPIEELRQFLEFQLPREWAPVFSDLPLTLSRKDHSPSTLQFTLLGPKLKVSKLQVIVGKRPVTGMRLYLEGKKCDRIAVHLQHLSAVPRLLQPLWEDHPFAGDAIWQDPDDYSTKYFEPVQWKNFSHVCTAPVENTETWIGDHAGASVVVGAQLAVKSFGLKNVLYLRLLYSRVPEARIRRSEWDHMPATTQKSGMFSSFLSTTFSSTQAPAPKAPPVVLNSGIFPEGPPRPVQDPKLLRFVDTTEMTKGPQDMPGHWLVTGAKLYLDKRRISLRVKYSLLTISSD

SEQ ID NO: 300 - protein, 640 aa, Asplenium australasicum
MASTVGGLAAMQAQSSEAAQPPNMSFTAFSIAQQAVDALGRGYDVNFDLRLGYCKQRKHLIENDELGPTQDLLLPGNISIPNLPASIKCDKGDRTRFTTEILTFNEMSEQFNQDLSISGKIPTGHFNTMFNFSGSWQKDASQVKTLALDGFFINLYTVELPRAQLTLKEEVRAAVPSSWDPAALASFVEKYGTHVIVGVKIGGKDVICLRQHHSSQLSAVGVQKILEAKAKERFTSIAGGTSRENNKGKIRDGFTYGSNAMIAVNGSKDGVHPSWLNSSLSDLPPVETDDVKVMFKRKGGKAVSQSHEEWLHTVPSSPDIVSMSFVPITSLLNGVTGTGFLSHAINHYLRYKPPIDQLRHFLEFQLPKDWAPAFGDLPLGPPRKQQASPSLQFRLMGPKLQVNTMPVVVGKRCVTGIRLHLEGKKSNRLAIHLQYLTAVPQILQGLWEDHRPDNWEGPDTDFSRYFEPVMWRSFSHVCTAPVESKEPWVDEMKGEPVLKGALVVTGAQLDVQQHGSKKVLFLRLLYSKIRKVRIRRSEWDHTPASQQRSGIFSTLISTHFSSAPSPLSKPVQVNSAIYPDGPPLANSQAPKLLKFVDTSAMTRGPLDLPGHWLVTGAKLCVERGKIAVRAKYSLLLYSED

SEQ ID NO: 301 - protein, 599 aa, Blechnum gibbum
MASGKDAAALAAVEALGCGFDLTSDYRLKYRKGPLLHLQHSSNKDLAIPGGITIPDVSRDVKCDKGERIRFASEVMQFQQMSQWFNQNASVEGKIPLGLFNAMFDLSGSWQDDAKQLKNLAFDGYFITLYKLHLTRSNLVLREEIKNDIPSVWDPLSLAKFIEKYGTHVIVSASVGGQDVLYLKENYSSLLSAQDIHKQLKSVGDGYFSDRGGEKSGNFKDNETLPLNALNSQPFRATVAHLHSAQVLVTNKDFTIISQRRGGYHFAKTHCGWQETVNIFPEAISLSFVPITSLISGFAGSGFLQHAINLYLRYKPPVSDIQYFLDFQVPRQWIPIHNELPLRLARKQTFSPSLQFSLTSPKLYINNNEVVVNRKPVTGIRLYLEGRKSNRLAIHIQHLSVLPQSLGQFWNEGTQLESPRWNGSNDAPKEWFEPVEWKCFSHVCTQPIKYKPEWLHDRDSAFVVTGARLEVKVHGLKSVLHLHLLFSKIPGCTIQRSRWDEHPAAEKTGFFSSISTTFSSTTKAGGKKGPPVLVDSAVFVGGPPRPIQCPKLLKYVDTAELTKGPQDAPGHWVVTAARLDLDGGKISLRVKFSLLNYAE

SEQ ID NO: 302 - protein, 612 aa, Tupidanthus calyptratus
MEGGEETVKPIGLRAMESLGLGFDFASDFRLKFAKRCPGAGGDDRLVVLDEASRRDVVFPGGGVIRGVPECIRCDKGDRIRFKSDVLKFNQMSELVNQKSSVQGKVPSGYFNAMFDLSGSWLNDAADANHLAFDGYFITLYCLHLTASPLVLRDKVKKSVPSHWNPASLSRFILTYGTHIIVGLAVGGQDVICVKQRPSSGIPPAELRGYLEDLGDCMFSDGRNPVLERKTRDGKQKVPEVFNRMLQSHTMQFSSITETSSKDGLTILSSKRGGDVFSQNHSNWLQTVASNPEAICFKLVPITSLLTGVPGSGYLSHAINLYLRYKPAPEDLRYFLEFQVPVQWAPLFCELPLRHQRRKASCPLLQFAFLGPKIHVSSTQVTSGEKPVVGLRLFLEGKKCNRMAIHAQHLSSLPNIMEFALSNSATSRPCQWRGSDDYISNDQFLEPVRWKRYSNVCSSVVEHDSNWIQGEEVGAFVVTGAQLISKGKWPKTILHLRLLFSYLPNCTIRKTEWAAAPEASQKSGFRLNLSTTFTFSQRTGADAPKQLPAALNSGVYPEGPPVPLRSKKLLKYVDVAEVVRGPHDTPGHWLVTAAKLVTDGGKIGLHVKFALL

SEQ ID NO: 303 - protein, 459 aa, Nephrolepis exaltata (compacta)
MSQQFNQGLSLSGKIPSGLFNYMFNFTGSWQKDASTTRHLALDGWFYTLYTVEIPRSQLVLKEDIKASVPTSWEAAALARFIETFGTHIIVGAKIGGKDVVYMKQHQSSPSTSIDFQKLLAEVSDERFAQTEGRTSVGSKDGRINKKKRGIEIQSWAAHLDTFSQITYNEKHHVTIIPRRKGGFDHGQSHSDWIHTVPLAPDIISVSLIPITSLLHGVSGSGFLSHAVNLYLRYKPPIEELRQFLEFQFPREWAPVFSELPLTLSRREHSVSTLQFTLMGPKLKVSKLQVTVGKKPVTGMRLFLEGKRCDKLAIHLQHLSAIPRFLQPLWEDHPFAREVTWQDPDDCSTKYFEPVQWKNFSHVCTAPVENMETWIGDHAGACVVIGAQLAVKSFGLKNVLYLRLLYSKIPEAKIRRSEWDHMPASTQKSGMFSSFLSSDQGSTGHAGTLVSNRGQALPG

SEQ ID NO: 304 - protein, 461 aa, Bolbitis cladorrhizans
MASSGGRLAALHPQSSEAAPRQNMSSLALSVAEHAVDALGRGYDVNSDLWLRSKHCECLIEDDKSGATQNLHLPGNIVIPNVPASVKCDKGDRTRFTSDILSFNEMSEQFNQTLSISGKIPVGHFNAMFNFTGSWQKDASQFKALAMDGVFINLYSVELPRTQLTLKEEVRAAVPSSWDPAALASFVEKYGTHVIVGVKIGGKDVICLKQHRSSSLSTVGVQKILESQAKERFSSVDSRAGKEKINKGKIRDGGSPFGSNGINAVHGLKDLSLISNSSSDSSKVETDDVIMIFTRKAGRNVSASHEEWLHTVASAPDIVSMSFVPITSLLNGVTGTGFLSHAINHYLRYKPPIQELRHFLEFQLPKEWAPAFGDLPLGPPRKQQASPSLQFRPMGPKLQVNTTPVVIGKRCVTGLRLHLEGKKGNRLAVHLQYLTVVPQILPLALCKHERSSSTSLAQNTC

SEQ ID NO: 305 - protein, 608 aa, Vernonia noveboracensis
MSFYQTNFYDPQSAAEKAVSVIGYGYDLTSDIRLTGCKPGPTGSTLIELDRTLSKDLVVPGGVVVHDVSPAIKCDKGERTRFHSDVLSFNHMSEQFNQEVSLSGKIPSGFFNSMFGYKGCWQKDAATTKNLAFDGWFITLYNIELEKAQIVLSEKVKQQVPSLWDPTALAEFIDKYGTHIVVGVKMGGKDVIYLKQLHSSNLEPTEVQNLLKQLADDEWSEDVSASSVSGPDKLIKQKDARSVAWDIPVLGNSIRQPIVISRSKKDDLLSIHVRQGGIDHGQSHKSWLSTVSQSPNVISMSFVPIVALLGGVRGSGFLSHAINLYLRYKPPIEELEQFLEFQLPRQWAPAYGDLPLAPRRKKTPSPSLQFTFLGPRLYVNTIKVDSENRPVTGVRLYLEGRKSDRLAIHLQHLSSTPKMLELSDDFSYKPSDGTIGKGYFEPVKWSIFSHVCTVPVEYNETRIDDPASIVTKAWFEVKGVGMKKVLFLRLGYSMVGSAMIRRSEWDGPSMHSRKSGIMSTLMSTPFSMGLATPEQKPVKVDLNSAIYPDGPPSKAPKMSSFVDTKEMIRGPEDPPGYWVVTGAKLCVEAGRIRVKVKYSLLTIMSEDS

SEQ ID NO: 306 - protein, 336 aa, Phormium (Lancer Terra Cotta)
MRPTDLMTPEAAAAAAVSAVGYGYDLVGDLRLSSCKAGPSGSRLIKIDDALVHDLVLPGGVVVPNVPKEIRCDKGERTRFRSDVLGFHQMAEQFNQDLSLSGKIPSGLFNAMFDFRGCWQKDLSSTKSLAFDGWFITLYSIELAKSHIVLQDKIKQEIPSSWDPVALAEFIEKYGTHIIVGIKMGGKDAVSIKQLQESALQQTEVQNLLKNLADDAFSEDFNANILLGAAEISKRLKGIKLANQENNAAVLKSMNSSIVTHLKKDDIVSIHVRRGGINTKQSHNQWLSTISQAPNVISMSFVPITSLLTGVRGSGFLRSAAERDSKSSKFLKLLKF

SEQ ID NO: 307 - protein, 388 aa, Tupidanthus calyptratus
MEGGEETVKPIGLRAMESLGLGFDFASDFRLKFAKRCPGAGGDDRLVVLDEASRRDVVFPGGGVIRGVPECIRCDKGDRIRFKSDVLKFNQMSELVNQKSSVQGKVPSGYFNAMFDLSGSWLNDAADANHLAFDGYFISLYYLHLIASPLVLRDKVKNSVPSHWNPASLSRFILTYGTHIIVGLAVGGQDVICVKQRPSSGIPPAELRGYLEDLGDCMFSDGRNPVLERKTRDGKQKVPEVFNRMLQSHTMQFSSITETSSKDGLTILSSKRGGDVFSQNHSNWLQTVASNPEAICFKLVPITSLLTGVPGSGYLSHAINLYLRYKPAPEDLRYFLEFQVPVQWAPLFCELPLRHQRRKASCPLLQFAFLGPKIHVSSTQVPTPFPLI

SEQ ID NO: 308 - protein, 396 aa, Tupidanthus calyptratus
MEGGEETVKPIGLRAMESLGLGFDFASDFRLKFAKRCPGAGGDDRLVVLDEASRRDVVFPGGGVIRGVPECIRCDKGDRIRFKSDVLKFNQMSELVNQKSSVQGKVPSGYFNAMFDLSGSWFNDAADSNHLAFDGYFISLYYLHLIASPLVLRDKVKNSVPSHWNPASLSRFILTYGTHIIVGLAVGGQDVICVKQRPSSGIPPAELRGYLEDLGDCMFSDGRNPVLERKTRDGKQKVPEVFNRMLQSHTMQFSSITETSSKDGLTILSSKRGGDVFSQNHSNWLQTVASNPEAICFKLVPITSLLTGVPGSGYLSHAINLYLRYKPAPEDLRYFLEFQVPVQWAPLFCELPLRHQRRKASCPLLQFAFLGPKTRMSSTQVIYLSTQTDMRMHRSL

SEQ ID NO: 309 - protein, 406 aa, Vernonia noveboracensis
MLKNQKLKAMADKRFLDSDGQYVIDAEHICHNDKDNIRGQRLRFADSDPSSSYSYKEDLVSIYKRRGGSDDRNLKHNEWLHSVQLEPDVISMSFIPITSLLNGVSGSGYLSHAINLYLRYKPPVEELHQFLEFQLPRQWAPVFSDLPLGPQRKQQTTPSLQFSFFGPKLYVNINPVDVGKRPVTGLRLYLEGKRSNRLAIHLQHLSSLPKVFQLEDDVDGNLAEESYDRRYYEKVQWKHFSHVCTAPVESDDELSIVTGAHLHVGDYGFKRILFLRLRFSTVVGAAAIKNPEWDGSPGLARKSGLISTLISHHFTAVLKSQPQAAEVNINSAIYPGGPPAPVQVPKLLKFVDTAEMTRGPQESPGYWVVSGARLVVDKGKISLRVKYSLLTVISADEEEEAAAAFY

SEQ ID NO: 310 - protein, 644 aa, Asplenium australasicum
MASAVGRFAATQAQSSEAAQPQITSSPAFSIAQQAVDALGRGYDVNFDLRLGYCKQRKHLIENDELGPTQDLLLPGNISIPNLPASIKCDKGDRTRFTTEILTFNEMSEQFNQDLSISGKIPTGHFNTMFNFSGSWQKDASQVKTLALDGFFINLYTVELPRAQLTLKEEVRAAVPSSWDPAALASFVEKYGTHVIVGVKIGGKDVICLRQHHSSQLSAVGVQKILEAKAKERFTSIAGGTSRENNKGKIRDGFTYGSNAMIAVNGSKDGVHPSWLNSSLSDLPPVETDDVKVMFKRKGGKAVSQSHEEWLHTVPSSPDIVSMSFVPITSLLNGVTGTGFLSHAINHYLRYKPPIDQLRHFLEFQLPKDWAPAFGDLPLGPPRKQQASPSLQFRLMGPKLQVNTTPVVVGKRCVTGIRLHLEGKKSNRLAIHLQFLTVVPQILQSRWEDDQLEDWEGPDTDFSKYFEPVMWRSFSHVCTAPVESREPWAADEMAGEAALKGALVVTGAQLDVEQHGSKKVLFLRLLYSKIHKAMNRRSEWDHTPASSQRSGIFSTLISTPFSSAAASSPAAAKPVHVNSAIYPDGPPPANSQAPKLLKFVDTSEMTRGPLDLPGHWLVTGAKLCVERGKIAVRAKYSLLLYSED

SEQ ID NO: 311 - protein, 536 aa, Tupidanthus calyptratus
MEGGEETVKPIGLRAMESLGLGFDFASDFRLKFAKRCPGAGGDDRLVVLDEASRRDVVFPGGGVIRGVPECIRCDKGDRIRFKSDVLKFNQMSELVNQKSSVQGKVPSGYFNAMFDLSGSWFNDAADSNHLAFDGYFISLYYLHLIASPLVLRDKVKNSVPSHWNPASLSRFILTYGTHIIVGLAVGGQDVICVKQRPSSGIPPAELRGYLEDLGDCMFSDGRNPVLERKTRDGKQKVPEVFNRMLQSHTMQFSSITETSSKDGLTILSSKRGGDVFSQNHSNWLQTVASNPEAICFKLVPITSLLTGVPDKPAPEDLRYFLEFQVPVQWAPLFCELPLRHQRRKASCPLLQFAFLGPKIHVSSTQVTSGEKPVVGLRLFLEGKKCNRMAIHAQHLSSLPNIMEFALSNSATSRPCQWRGSDDYISNDQFLEPVRWKRYSNVCSSVVEHDSNWIQGEEVGAFVVTGAQLISKGKWPKTILHLRLLFSYLPNCTIRKTEWAAAPEASQKSGFRLNLAQLSHSVSELVLMHQSSFQLH

SEQ ID NO: 312 - protein, 597 aa, Verbascum chaixii (Vill)
MSDEIVKSALASLGKGFDLSSDFRLKYCKGDDRLVMLNQTHTRQLSVPGFGSFNNISIDIKCDKGDRTRYQSDILDFNQMSELFNHKCSVPGKIPSGSFNSMFGFQSGSWANDAGNTKYLGLDGYFIVLFDVHIDRYPLILADEVRNDVPSTWDPSALARFIEKYGTHIIVGISIGGEDVVLVKQDKSSNMEPSQLKNHLDNLGDQLFNGACTFPPHQFKNKEQKYKAPEAFNVFDPQPNIFSNFATITAKDGISVICSKMGGDTTVSTHCEWLLTVPSKPDAIHFNFIPITSLLRGIPGKGFLSHAINLYLRYKPPIADLKYFLDFQAHRIWAPIHNDLPLGPIRSKALQTPALHFNMMGPKLYVNTSQVTVGNTPVTGMRLYLEGMKCNRLGIHLQHFINPPVLLQDKILEPPTWRGSHETPDHHRYLEPIQWKKFSHICTSPVKFDPEWLNPGQDAAYIVTGAQLHVKKHESKTVLHLRLSYSKVSNCYVVQSNWMQFASDNHSMKSGFFSSISTSISGSVEKEKMATVIVDSGVYPTGPPVQTQKMLKFVDTSEMRRGPSDNPGHWLVTGAKLDLEKGKICLRVKFSLLNVCS

SEQ ID NO: 313 - protein, 314 aa, Sphaeropteris cooperi
MGSEAAARKVALDAVQSLGRGFDVTADFRTKFCKKRLVHIVNDGLESLTLPGDITIDAPSVIKCDKGECTRHTSDLMQFQQMSQAFNKRALIDGKIPLGHFNAMYDFTGSWFEDAMQTKNLAFDGKFITLFQLQLTSSLLLRKEVKNAVPSAWEPAALARFISLYGTHIVVRVSVGGQDVLYLKENASSMMSSADVHKHLKNLGDQMFAEKGVQKIQDGNSLRGCSIAPVEIDGTNILYKSKDLTIIAKKRGGRLCAKTPSEWQATVMSAPDVIMMSFVPITALLSGTPGSGFLNHAINLYLRCSKSTRFKYIL

SEQ ID NO: 314 - protein, 606 aa, Symphoricarpos x chenaultii (Hancock)
MGSSKETAKRLKALAEVAIESIGLGYDVAEDLRIKYCKDKSTRLITIDDDQVRDIVIPGGILIPNVSKSIKCDKGERMRFSSDVLSFQQMSEQFNQEVSLSGKIPTGHFNAAFEFTGSWQKDAANTKALAFDGVFITIYSIALEKTQIALCDHIKQAVPSSWDPPALARFIEKFGTHVVVGVKMGGKDSIYVKQQHSSPLQPDEVQKRLKDVADKRFSDAGGQNNTNDRFGNNELGLTFMDSTTSSSYLHKEDITLFWRRRGGSTSKNLDHNKWCQSVQLEPDVISMSFIPISSLLSGVHGSGFLSHAINLYLRYKPPIEELHQFLEFQLPRQWAPVFGELAVGPERKQQNGASLQFSFMGPKLYVNSNLVDVSKPVTGLRLYLEGKRNNCLAIHLQHLSTLPKSFHLEDDPKSNSSQTVYDRRYYERVQWKNFSHVCTAPIESSYSDDEKNDLSIVTGAQFEVRESGMKRVLFLRLHFSRAVGSMVVKKPEWDGSPVLTQKSGIISNLLSSHLSSTAQKQAPPLPSDVNINSALYPGGPPVPAQATKLLRFVDTTEMTRGPQDPPGYWVVSGARLVVDKGKISLRVKYSLLAPVILPDEEEEVPL

SEQ ID NO: 315 - protein, 604 aa, Tupidanthus calyptratus
MGSSKEIGLKLKATAEAAIQSIGFGYDITEDLRLKYCKGSRLIVIDDDQVRDIVIPGGILVPNVSKQINCDKGERIRFSSDGLSFQQMSEQFNQEVSLSSKIPTGHFNAAFQFTGCWQKDAANTKTLALDGVFITIYTIALEKSQITLCDHIKEAVPSSWDPAALARFIEKFGTHVIVGVKMGGKDIVYMKQQHSSPLQSDEVQKRLKHVADNRFSNASGHSTNPEKVYEREMLEINEPPQEFMDDSASSSYMDLEDITFFYRRRGGSNKKNLPHDKWCQSVQLEPDVISMSFIPISSLLSGINGNGFLTHAINLYLRNLYLRYKPAIEELSQFLEFQHPRQWAPVFGELAVGPERKQQSGASLQFSFLGPKLYVNTTLVDAGKRPVTGLRLYLEGTKSNCLAIHLQHLSTLPKSFQLQDEATCNYGSNDQRYYEKVQSKSFSHVCTGPVESDEDHSIVTGAQFEVRNSGMKRVLFLRLHFSKVIGSTVFKQPEWDGSPIIAQKSGIISTLISSRFSANQKQPPRPSDFNINSAIYPSGPPVPAQATKLLRFVDTSEMTRGPQDRPGYWIVSGARLLVDRGKISLCVKYSLLAVILPEDEMSLQ

SEQ ID NO: 316 - protein, 462 aa, Vernonia noveboracensis
MFPRRLSAIKVNAPGFTPTFFPSIMFIDKYGTHIVVGVKMGGKDVIYLKQLHSSNLEPTEVQNLLKQLADDEWSEDVSASSVSGPDKLIKQKDARSVAWDIPVLGNSIRQPIVISRSKKDDLLSIHVRQGGIDHGQSHKSWLSTVSQSPNVISMSFVPIVALLGGVRGSGFLSHAINLYLRYKPPIEELEQFLEFQLPRQWAPAYGDLPLAPRRKKTPSPSLQFTFLGPRLYVNTIKVDSENRPVTGVRLYLEGRKSDRLAIHLQHLSSTPKMLELSDDFSYKPSDGTIGKGYFEPVKWSIFSHVCTVPVEYNETRIDDPASIVTKAWFEVKGVGMKKVLFLRLGYSMVGSAMIRRSEWDGPSMHSRKSGIMSTLMSTPFSMGLATPEQKPVKVDLNSAIYPDGPPSKAPKMSSFVDTKEMIRGPEDPPGYWVVTGAKLCVEAGRIRVKVKYSLLTIMSEDS

SEQ ID NO: 317 - protein, 669 aa, Aglaomorpha (Roberts)
MASAAGGFAALQPQSSEAARPQYTPFSVAQQAVDALGRGYDVNSDLWLRYCQHTERLIDSNPGPTQDLLLPGNILIPKVSASIKCDKGDRTRFTSDVLTFNEMSEQFNQNLAMSGKIPVGHFNSMFGFSGSWQRDASAVKTLAMDGVFITLYSVELPRAQLTLKEEVKAAVPSSWDPAALASFLEKYGTHVIVGVKIGGKDVICLKQHRTSSMSAVGVQKILEAKGKERFSSIEGSAAKEKINKGKIRDGSPFGSNGMNAVNGSKDLPWMSDSSTEYSTVETDDVTVIFKRKGGRDLSQSHEEWLRTVPSFPDIVSMSFVPITSLLNGVTGTGFLNHAINHYLRYKPPIQELHHFLEFQLPKEWAPAFGDLPLGPPRKQAGSPSLQFRLMGPKLQVNTTPVVIGKRCVTGLRLHLEGKKSNRLAIHLQYLTVVPQIGKRCVTGLRLHLEGKKSNRLAIHLQYLTVVPQILQQLWQDDQPEEWEGPDDDFSKYFEPVMWKSFSHVCTAPVESTETWEDEGRGGSGSKGAQVVTGAQLDVLQCGSKKVLFLKLLYSRIHKAKIRRSEWDHTSASQQKSGIFSTLMSTTFSSAQAAPQKPVQVVVNSAIYPQGPPAANSQAPKLLKFVDTSEMTRGPLDLPGHWLVTGAKLFVDRGKIAVRAKYSLLLYSVD

SEQ ID NO: 318 - protein, 260 aa, Waldsteinia ternata
MRFGSDVLSFQQMSEQFNQELALSGKIPSGHFNTAFEFTGGWQKDAANTKTLAFDGVSITLYSVALEKSQVSLREQVKQDVPSSWDPTALARFISKYGTHVIVGVKMGGKDTIYAKQMYSSPVQPADVQKKLKDMADKMYVDGNSHSGVTSEKFHERDKFIKEQGLGIMNAIPSSSYASVESQDIKFVCKRKGGSLHKNLRHSEWSQTVQLEPDVISMSFVPITSLLSGIHGSGFLTHAINLYLRCKLLNSPHLFTTAVT

SEQ ID NO: 319 - protein, 598 aa, Tupidanthus calyptratus
MEGGEETVKPIGLRAMESLGLGFDFASDFRLKFAKRCPGAGGDDRLVVLDEASRRDVVFPGGGVIRGVPECIRCDKGDRIRFKSDVLKFNQMSELVNQKSSVQGKVPSGYFNAMFDLSGSWLNDAADANHLAFDGYFISLYYLHLIASPLVLRDKVKNSVPSHWNPASLSRFILTYGTHIIVGLAVGGQDVICVKQRPSSGIPPAELRGYLEDLGDCMFSDGRNPVLERKTRDGKQKVPEVFNRMLQSHTMQFSSITETSSKDGLTILSSKRGGDVFSQNHSNWLQTVASNPEAICFKLVPITSLLTGVPDKPAPEDLRYFLEFQVPVQWAPLFCELPLRHQRRKASCPLLQFAFLGPKIHVSSTQVTSGEKPVVGLRLFLEGKKCNRMAIHAQHLSSLPNIMEFALSNSATSRPCQWRGSDDYISNDQFLEPVRWKRYSNVCSSVVEHDSNWIQGEEVGAFVVTGAQLISKGKWPKTILHLRLLFSYLPNCTIRKTEWAAAPEASQKSGFRLNLSTTFTFSQRTGADAPKQLPAALNSGVYPEGPPVPLRSKKLLKYVDVAEVVRGPHDTPGHWLVTAAKLVTDGGKIGLHVKFALL

SEQ ID NO: 320 - protein, 289 aa, Microsorum musifolium (Blume)
MASKPGIPNAAKIAHLAIQSLGRGYDLTCDLRFSSFKDVNGASLIDLKNNETIDLSLPGGVVIANVPAIVKCDKGERTRFRSDILSFDQMSEQFNHGLSLSGKIPCGLFNNMFSFTGSWQKDASTTKHLALDGWFYTLYTVEMPRSQLVLKKDIKASVPSSWEPAALARFIETFGTHIILGVKIGGKDVVYMKQHQSSPSTSIEFQKLLAEVSDERFLQIEGRASVGSKNSHNNKKHNIEFQSSPSTSIEFQKLLAEVSDERFLQIEGRASVGSKNSHNNKKHNIEFQS

SEQ ID NO: 321 - protein, 327 aa, Nephrolepis exaltata (compacta)
MASKLDIPNAAKVANIAIQSLGRGYDLTCDLRFSTFKDVNGASLIELRNNETLELSLPGGVVVTNVPAIVKCDKGEQTHFRSDIVTFDQMSQQFNQGLSLSGKIPSGLFNYMFNFTGSWQKDASTTRHLALDGWFYTLYTVEIPRSQLVLKEDIKASVPTSWEAAALARFIETFGTHIIVGAKIGGKDVVYMKQHQSSPSTSIDFQKLLAEVSDERFAQTEGRTSVGSKDGRINKKKRGIEIQSWAAHLDTFSQITYNEKHHVTIIPRRKGGFDHGQSHSDWIHTVPLAPDIISVSLIPITSLLHGVLVRAILIGFTLSLLLLILFP

SEQ ID NO: 322 - protein, 591 aa, Aglaomorpha (Roberts)
MASAKDAAALAAVEALGCGFDLTSDYRLKYKKGSLLELQRSHNKDLTIPGGITIPDVSRDIKCDKGERMRFASEVMQFQQMSQWFNQNASIEGKIPLGLFNAMFDLSGSWQDDASRLKSLAFDGSFITLYKLHLTRSNLVLREDVKKDIPSVWDPKSLAKFIEKYGTHIIVSASVGGQDVLYLKENDSSLLSAQDIRKKLKSAGDDYFSENSGKRNTDFKDSETLPLNSQPFRGTIAASAQLLISNKDYTVLSQRRGGYYFAKTHCEWQETVNMYPEAISLSFVPITSLVLGAAGSGFLQHAINLYLRYKPPVSDLQYFLDFQVPRQWIPVHNELPLRLARKQAFSPSLQFSLMSPKLYINNNEVVVNKKPVTGIRLYLEGRKNNRLGIHLQHLSVLPQSLGQFWSEGTQIESPQWNGSNDAPNDWFEPVEWRCFSHVCTQPIKFKSEWLNERDSAFVVTGARLDVKAHGLKSVLHLHLLFSKIPGCTIQRSRWDQHLAAEKTGFFSSISTTFSTTTKAGKKSPQVVVDSAVFMGGPPRPIQSPKLLKFVDTAELIKGPQDAPGHWVVTAARLELDRGRVESEDIVLLQGS

SEQ ID NO: 323 - protein, 606 aa, Tupidanthus calyptratus
MALKVSAPEASAPEAAKIAIQSIGCGYDISLDLRLKYCKGDLTNPRLIEIHEDQGREIVLPGGIVIPNVSKAIKCDKGEHARFRSDVLSFQQMSEQFNQEMSLTGKIPSGVFNTMFEFTGSWQKDAANTKTLAFDGVFITLYTVALEKTQMILSDHVKQAVPSSWDPAALARFIEKFGTHIIVGVKMGGKDVIYMKQQHSSSLQPSDVQKRLKTIADKRFVDASGQYGMDSEQTHQNDKFQIREQRLRFADTSPSSSYSYKEDIVIICKRRGGSDNKNLTHNEWLHNVQLEPDVISMSFIPITSLLNGVSGSGFLSHAINLYLRYKPPVEELHQFLEFQLPRQWAPVFSDLPLGPQRRQQSTSSLQFSLMGPKLYVNTTPVDVGKRPVTGLRLYLEGKRSNRLAMHMQHLSSLPKVFQLKDDPNGNFRQESYDHRYYEKVQWKNFSHICTAPVESDEDLSIVTGAQLEVGDYGFKRVLFLRLRFSTVLGAVAVKHPEWDGSPGLARKSGLISTLISHHFTATLKPPPQPADVNINSAIYPGGPPAPTQSAKLLKFVDTTEMTRGPQETPGYWVVSGARLMVEKGRISLRVKYSLLTVMLPDEEALE

SEQ ID NO: 324 - protein, 306 aa, Tupidanthus calyptratus
MYRRRLSAVKASDRTLTKDLNLPCGRVVRNVSPSIKCGKGEQTRFHSDVLTFVQMSEQFNQDISLSGKIPSGLFNAMFDFKGCWQKDAATTKSLAFDGWFFSMYNIELARSQITLSEQVKKEVPSSWDPAALAEFIEKYGTHIVVGVKMGGKDVIHLKQLQNSNLQPTEVQKLLKQLADERFSEDVNGSLIPNPEKSSGKQKEEPSIVQDLNLPFANLLRQAVVSQSKNDDLLSIRIRRGGFDTGQSHKQWLSTVSQFPNAISMSFVPLASLLSGIRGSGFLSHAINLYLRYKPPMEELEQFLEFQ

SEQ ID NO: 325 - protein, 574 aa, Passiflora coccinea x Passiflora incarnata (Lady Margaret)
MRQRRQEGDRTRLIEIDEDEGREIVLPGGVSIPNVSKSIKCDKGDRTRFRSDVLSFQQMSEQFNLELSLTGKIPSGLFNSMFEYSGCWQKDAANTKALAFDGVFITLYSVALGKSHMELCDRVKKAVPSSWEPAALAKFIETFGTHIIVGVKMGGKDVIYIKQQHSSTLQPADLQKRLKEMADKRFLDTNGQYSMTSEQAFQSNKFEIREQRLRFADISPSSSYSHKEDIVRIYKRRGGSDNGVLSHSEWLHTVQSEPDVISMSFIPITSLLNGVPGSGFLSHAINLYLRYKPPIEELYQFLEFQLPRQWAPVFSELPLGPQRKQQNSASLQFSLMGPKLFVNVTPVDVGKRPVTGLRLYLEGKRSNRLAIHLQHLSSLPKIFQLIDDPNGNFQKDSYDRKYYEKVQWKHFSHVCTAPVESDKDLSIVTGAQLQVENSGFRNILFLRLRFSTVLGAVVVKHPEWDGSPGLFPKSGLISTLISHHFTAVQKPPPRPADVNINSAVYPGGPPVPVQTPKLLKLVDTTEMTRGPQETPGYWVVSGARLVVEKGRISLRVKYSLLTVVQSDDDIEEEL

SEQ ID NO: 326 - protein, 601 aa, Phormium (Lancer Terra Cotta)
MALKVPLQKAAEIAINSIGLGYDIATDIRLKYCKRESPDPCLIELENGQVQDIVLPGGITVSNVPKSIKCDKGERTRFRSDVLSFQQMSEQFNQELSLSGKIPSGLFNYMFEFSNCWQKDAANTKSLAFDGWFITLYTVALAKSQIVLRDHVKQAVPSSWDPAALARFIEKFGTHVIVGVKMGGKDVIYVKQQHFSNLQPAEVQKILKDMADKRFLDVSGQYGMNSEEAFGKDKFDFKEQRLRFADSSSSSSYSTKEDIVRIFKRRGGNDNKDLPHPEWLNTVQYEPDVISMSFVPITSLLQGIPGSGFLSHAINLYLRYKPPTEELHQFLEFQLPRQWAPVFSDLPLGPQRKHQSTASLQFTFMGPKLYVNTSVVDVGKRPVTGLRLYLEGKRSNRLAIHLQHLSSLPRIFELREDPSSSYSRESHDRKYYEPIQWRHFSHVCTAPIEADEDNSIVTGAQLHVGHYGLKKVLFLRLHFSTVSNVTLVRNHEWDGSPGLAHKSGLISTLISTRFTAAIQKPPPRPADVYINSAVYPGGPPVPVQTPKLLKFIDTTEMVRGPQNPPGYWVVSGAKLQLERGKISLRVKYSLLTVLVPDDDDV

SEQ ID NO: 327 - protein, 609 aa, Ophioglossum pendulum
MAACQPSPESVSVARQAIQALGRGYDVVSDLRLSYCKGEPGSPLVILDNARTQDIAVPGGITIHSVPKIIKCDKGERTRFCSDVLPFNQMSEHFNQGLFISGKIPLGLFNAMFGFSGSWQRDALSSKSLAMDGWFVTLYSAELPRSQLQLQEEVVKAVPTTWDPAALARFIDNYGTHIIVGIKIGGKDVIYLKQHQSSNLSPVEIQKILKKKANEVFSGLEERSSLDSKERADTDRVIEQQAWMNQGSRGPVTSYLKKEDITILHHRRGGNDHIDGQSHDKWLQTLLNAPTVISMSFVPITSLLSGVPGCGFISHTVNLYLRYKPQIEELHHFLEFQLPRQWAPVFSELPLGPPRKERGTPALQFSLLGPRLYVNTSSLNVGKKPVTGLRLFLEGKKNNRLAIHLQHLSSLPRILQPLWEQHTEEPKWQDPEAFDSRFFEPVLWRSFTHVCTAPVENSETWIGDPAGAYVVIGAQLRVLEAVTKNVLYLKLLYSRIPQATIRRSEWDHTPATAQKTGFFSTFMSTTFSSTPPQPKPVPVVMNSGVFAGGPPVPVQVPKLLKFVDTTEMTKGPQDAPGHWLVTGAKLYLDRGKVSLRVKYSLLIYGNTSP

SEQ ID NO: 328 - protein, 570 aa, Tupidanthus calyptratus
MEGGEETVKPIGLRAMESLGLGFDFASDFRLKFAKRCPGAGGDDRLVVLDEASRRDVVFPGGGVIRGVPECIRCDKGDRIRFKSDVLKFNQMSELVNQKSSVQGKVPSGYFNAMFDLSGSWLNDAADANHLAFDGYFITLYCLHLTASPLVLRDKVKKSVPSHWNPASLSRFILTYGTHIIVGLAVGGQDVICVKQRPSSGIPPAELRGYLEDLGDCMFSDGRNPVLERKTRDGKQKVPEVFNRMLQSHTMQFSSITETSSKDGLTILSSKRGGDVFSQNHSNWLQTVASNPEAICFKLVPITSLLTGVPDKPAPEDLRYFLEFQVPVQWAPLFCELPLRHQRRKASCPLLQFAFLGPKIHVSSTQVTSGEKPVVGLRLFLEGKKCNRMAIHAQHLSSLPNIMEFALSNSATSRPCQWRGSDDYISNDQFLEPVRWKRYSNVCSSVVEHDSNWIQGEEVGAFVVTGAQLISKGKWPKTILHLRLLFSYLPNCTIRKTEWAAAPEASQKSGFRLNLSTTFTFSQRTGADAPKQLPAALNSGVYPEGPPVPLRSKKLLKYVDVAEVVRGPHD

SEQ ID NO: 329 - protein, 275 aa, Nephrolepis cordifolia (Duffii)
MSEQFNQNLSISGKIPVGHFNAMFGFSGSWQKDASVVKTLAMDGVFITLYSVELPRTQITLKEEVRAAVPSSWDPAALASFVEKYGTHVIVGVKIGGKDAICLKQHRSSSLSAVEVQKILETKAKERFLSVEGNTAKERINKGKIRDGSPYGSNGMAALNLSKDETTLSWLSDTSTDHSTVETNDVTVIFKRKGGRENSTSHDEWLHTVASFPDIVSMSFVPITSLLNGITGTGFLSHAINHYLRYKPPIQELHHFLEFQLPKEWAPAFGDLPLG

SEQ ID NO: 330 - protein, 601 aa, Tupidanthus calyptratus
MALKVSAPEAAKIAIQSIGCGYDISLDLRLKCCKGDPANPRLIEIHEDQGREIVLPGGIVIPNVSKAIKCDKGEHARFRSDVLSFQQMSEQFNQEMSLTGKIPSGVFNTMFEFTGSWQKDAANTKTLAFDGVFITLYTVALEKTQMILSDHVKQAVPSSWDPAALARFIEKFGTHIIVGVKMGGKDVIYMKQQHSSSLQPSDVQKRLKTIADKRFVDASGQYGMDSEQTHQNDKFQIREQRLRFADTSPSSSYSYKEDIVIICKRRGGSDNKNLTHNEWLHNVQLEPDVISMSFIPITSLLNGVSGSGFLSHAINLYLRYKPPTEELHQFLAFQLPLHWAPVFSVHPLGLQPRQQSTASLQFSFMGPKLHVNTSPVDVGKRPVTGLRLYLEGKKSNRLAIHMQHLSSLPEFFQLEDDPNGNFRQESYDRRYYEKVQWKNFSHICTAPVESDEDLSIVTGAQLEVGDYGFKRVLFLRLRFSTVLGAVAVKHPEWDGSPGLARKSGLISTLISHHFTATLKPPPQPADVNINSAIYPGGPPAPTQSAKLLKFVDTTEMTRGPQETPGYWVVAGARLMVEKGRISLRVKYSLLTVMLPDEEALE

SEQ ID NO: 331 - protein, 636 aa, Platycerium wandae
MASAAGGFAALQPQSSEAGAPQSTAFSVAQLAIDALGRGYDVNCDLWLRNCPHNERLIEDNPGPTQDLLLPGNIVIPNVAASIKCDKGDRTRFTSDVLTFNEMSEQFNQNLALSGKIPVGHFNAMFGFSGSWQKDASAVKNLAMDGVFITLYSVELPRSQLILKEEVKAAVPSSWDPAALASFLEKYGTHIIVGVKIGGKDVICLKQHRSSSLSAVGVQKILEAKGKERFSSVEGSTSKEKINKGKIRDGSSFGSNGMNALNGSKDLPWMSDSSTDYSTVETEDVTVIFKRKGGRDRSQSHDEWLHTVPLFPDVVSMSFVPITSLLNGITGTGFLNHAINHYLRYKAPIQELHHFLEFQLPKEWAPAYGDLPLGPPRKQAGSPSLQFRLMGPKLQVNTTPVVIGKRCVTGLRLHLEGKKSNRLAIHLQYLTVVPQILQQLWQDNQPEVWEGPDEDASKYFEPVMWKSFSHVCTAPVESTETWEDEGKGDPESKGAQIVTGAQLDVLQCGSKKVLYLKLLYSKIHKARVRRYEWDHMPASQQKSGIFSTLMSTTFSSAQASPQKPVQVVVNSAIYPQGPPAANSQAPKLLKFVDTAEMTRGPLDLPGHWLVTGAKLFVDRGKIAVRAKYSLLLYSVD

SEQ ID NO: 332 - protein, 609 aa, Nephrolepis falcata
MASKRDIPNAAKVANSAIQSLGRGYDLTCDLRFSTFKDVNGASLIELRSNETRELSLPGSVVVTNVPAIVKCDKGEQTHFRSDILTFDQMSQQFNQGLSISGKIPSGLFNYMFNFTGSWQKDASTTKHLALDGWFYTLYTVEIPRSQLVLKEDIKASVPTSWEAAALAKFIETFGTHIIVGAKIGGKDVVYMKQHQSSPSTSIDFQKLLVEVSDERFSQTEGRTSVGSKDGRINKKKRGIEFQSWAAHLDTFSQITYNEKHHVTIIPRRKGGFDHGQSHSDWIRTVPLAPDVISVSLIPITSLLHGVSGSGFLSHAVNLYLRYKPPIEELRQFLEFQFPREWAPVFSELPLTLSRREHGVSTLQFTLMGPKLKVSKLQVTVGKKPVTGMRLFLEGKRCDKLAIHLQHLSAIPRFLQPLWEDHPFAREVTWQDPDDCSTKYFEPVQWKNFSHVCTAPVENMETWIGDHAGASVVIGAQLAVKSFGLRNVLYLRLLYSKIPEAKIRRSEWDHMPASTQKSGMFSSFLSSTFSSAPAPAKVPAVVINSGIYPEGPPKPVRDPKLLKFVDTTEMTKGPQDMPGHWLVTGAKLYLDKGKISLRVKYSLLTVSSD

SEQ ID NO: 333 - protein, 320 aa, Celosia argentea (Sylphid)
MALKLSAAKAAEVAIGSIGRGYDISADLRLKFCKGDTLDSHLIEIDEDHCQEIALPGGISIPNVPTSIKCDKGERTRFRSDVLSFQQMSEQFNQEISLTGKIPSGLFNTMFEFSGCWQKDAAYTKTLAFDGVFITLYTVALEKSQLVLRDHVKQAVPSSWEPAALARFIEKFGTHIIVGIKMGGKDVVFVKQQHSSSLQPAEVQKKLKEIADKRFLEANGQSEFNAGHIYQDGKFDAREQRLRFADLSPSCSYSHKEDIVTICKRRGGSDIKNLPHHEWLQTVQSEPDVISMSFIPITSLLNGVPGSGFLSHAINLYLRC

SEQ ID NO: 334 - protein, 383 aa, Onoclea sensibilis
MASKHDIPNAAKVANIAIQSLGRGYDLICDLRFSSCKDVHGAPLIDLSNKETHKLSLPGGVVVANVPTIVKCDKGERTHFRSDILTFDQMSQQFNQGLSLSGKVPCGLFNYMFNFTGSWQKDASTTRHLALDGWFYTLYTVEIPRSQLVLKEDIKASVPTSWEPAALARFIETFGTHIIVGAKIGGKDVVYMKQHQSSPSTSIDFQKLLAEVSDERFLQTESRASVGSKDSRSNKKHSVEFQSWSAHLDTFSQIIYNEKHHVTIIPRRKGGFDHGQSHSEWIHTVPLAPDVISVSLVPITLLLNGVAGSGFLSHAVNLYLRYKPHIEELRQFLEFQLPREWAPVFSELPLTLSRREHSPSTLQFTLMGPKLKVSKLQKCLLCR

SEQ ID NO: 335 - protein, 378 aa, Asplenium australasicum
MASKHDIPNAARVANLAFQSLGRGFDLTCDLRFSSCKDVHGAPLIELSDKDLRKVSLPGGVIVPNVPTIVKCDKGEQTHFRSDILTFDQMSQEFNHGLSLSGKVPSGFFNYMFNFTGSWQKDASATRHLALDGWFYTLYTLEMPRSQLVLKEDIKAAIPTSWEPAALARFIETFGTHIIIGAKIGGKDVVYLKQHQVSTSTLADFQKLLAEVSEERFSQTEGRASVGSKDSHSNNKRSMQFKSWTAPLDSFSQIIYNDKHHVTIIPRRKGGFDHGQSHSDWVHTVPLAPDVISVSLVPITSLLNGVPGSGFLSHAVNLYLRYKPPTEELRQFLEFQLPREWAPVFSELPLTLCRREQSPSTLQFTLMGPKLKVNKSQR

SEQ ID NO: 336 - protein, 415 aa, Asplenium australasicum
MASKHDIPNAARVANLAFQSLGRGFDLTCDLRFSSCKDVHGAPLIELSDKDLRKVSLPGGVIVPNVPTIVKCDKGEQTHFRSDILTFDQMSQEFNHGLSLSGKVPSGFFNYMFNFTGSWQKDASATRHLALDGWFYTLYTLEMPRSQLVLKEDIKAAIPTSWEPAALARFIETFGTHIIIGAKIGGKDVVYLKQHQVSTSTLADFQKLLAEVSEERFSQTEGRASVGSKDSHSNNKRSMQFKSWTAPLDSFSQIIYNDKHHVTIIPRRKGGFDHGQSHSDWVHTVPLAPDVISVSLVPITSLLNGVPGSGFLSHAVNLYLRYKPPTEELRQFLEFQLPREWAPVFSELPLTLCRREQSPSTLQFTLMGPKLKVNKSQVTIGRRPVTGMRLFLEGKRCDRLSIHLQHLSEIGRAHV

SEQ ID NO: 337 - protein, 624 aa, Equisetum
MERESMESHEAAQHLDVANNSSHSNLSCKVGRQALECLGQGFDVTADFRLRYCKPLGSKGSLIKLGSGQCQKVKLPGDIVREIPACIKCDKGERIRFTSDVMQFSQMAEFFNHHSSIEGKIPLGSFNAVYQLSGLWQTDATLVKRLAFDGCFITLYTMKLSRNLVLKDEVLADVPSTWEPEALTRFIMKYGTHIVVGVRVGGQYVLYLKVNQSSLLSSTEIHEKLKRLGDEIFNDSSSNNIIFSRERNNQVAYTPTAVIHSAQPPIVTKDCTIIPSKRGGNLHADTYKEWQSTVDSNPDVISLSFVPITSLMSGLPGKGFLNHAINLYLRYKPKIEELQYFLEFQIPRQWAPIYGELSLGPPRTQAPSASMRFSFMGPVLYVNTSQVWVCKKPVTGVRLYLEGRKNNRLAIHLQHLSNMPQAVLQCMGGEEPSIWHGTVDLLDRVNRYMEPVQWKRFSHVCTAPVRYNPEWLESNQQRGGVYIVTGAQLLVKGSGFKKNLHLRLQFTRIPCATIQKSTWEQPSNSTQKSTFFSAISTPFGIPAAKKAAEKSPPPVMVNSGVFFGSPPSPVQTPRLLKYVDTTELTKGPQDLPGHWLVTAAKLCLEQGKISLRVKYSFLNYQEFD

SEQ ID NO: 338 - protein, 592 aa, Celosia argentea (Sylphid)
MALKLSAAKAAEVAIGSIGRGYDISADLRLKFCKGDTLDSHLIEIDEDHCQEIALPGGISIPNVPTSIKCDKGERTRFRSDVLSFQQMSEQFNQEISLTGKIPSGLFNTMFEFSGCWQKDAAYTKTLAFDGVFITLYTVALEKSQLVLRDHVKQAVPSSWEPAALARFIEKFGTHIIVGIKMGGKDVVFVKQQHSSSLQPAEVQKKLKEIADKRFLEANGQSEFNAGHIYQDGKFDAREQRLRFADLSPSCSYSHKEDIVTICKRRGGSDIKNLPHHEWLQTVQSEPDVISMSFIPITSLLNGVPGSGFLSHAINLYLRYKPPLEELHQFLEFQLPRQWAPVFSELPLGPQRRQQNYASLQFSFMGPKLYVNTIPVDVGSRPVTGLRLYLEGRKSNRLAIHLQHLSSLPKIFQLKDDPSGNFHQLHYDRRFYEKVGWKNFSHVCTAPVESDEDLSIVTGAQLQVGDYGFKKVLFLRLRFSTVLGATLVKNPEWDGSPGLARKSGLISTLISQHFTAVAKPLPQPADVNINSAVYPGGPPVPVQAPKLLKFVDTTEMTRGPQDTPGYWVVSGAKLVVEKSKISIRVKYSLLTP

SEQ ID NO: 339 - protein, 526 aa, Prostanthera rotundifolia
MRFSSDVLSFQQMSEQFNQELSLSHKIPTGHFNAAFEFTGSWQKDAAFTKSLAFDGVFITLYSIALEKSQVTLQDHVKQAVPSSWDPAALARFIEKYGTHIIIGVKMGGKDVVYVKQHYSSPLQPIDVQQRLKDAADKRFSDANGQSSMHPEKSYGREMPVSNERGFAFSDPGTPSFHSNQEEFTFFWRRRGGGSDRNMPHTKWSQTVQIEPEVISMSFIPISSLLSGIDGSGFLGHAINLYLRYKPPIEELHQFLEFQLPKQWAPVFGNVPLGPDRKQQGAASLQFSLMGPKLYVNTEEVDVGNKPVTGLRLYLEGKRSNCLAIHLQHLSSLPKSFQLRNESGGNSNSSDRRYYEKVQWKSFSHVCTAPVESDDDLSIVTGAQFEVKESGMKNVLFLRLRFSKVTGATVVKKPEWDGSPALSQKSGIISTLISSHFSTGQKPGPKPSDVNINSALYPDGPPMPAQTLKLLKYVDTVEMTRGPQDPPGYWVVSGARLVVDKGKISLRVKYSLLAVILPDEEALLQG

SEQ ID NO: 340 - protein, 656 aa, Tupidanthus calyptratus
MAFNANRFDPQSAAEKAVSAIGSGYDLTVDIRLSECKPGPSGSGLIELDRTLTKDLNLPCGRVVRNVSPSIKCGKGEQTRFHSDVLTFVQMSEQFNQDISLSGKIPSGLFNAMFDFKGCWQKDAATTKSLAFDGWFFSMYNIELARSQITLSEQVKKEVPSSWDPAALAEFIEKYGTHIVVGVKMGGKDVIHLKQLQNSNLQPTEVQKLLKQLADERFSEDVNGSLIPNPEKSSGKQKEEPSIVQDLNLPFANLLRQAVVSQSKNDDLLSIRIRRGGFDTGQSHKQWLSTVSQFPNAISMSFVPLASLLSGIRGSGFLSHAINLYLRYKPPMEELEQFLEFQVPRQWAPVYGDLPLAPRRKKQASPSLKFTFMGPRLYVNTIRVDSENRPVTGIRLYLEGKKSDHLAIHLQHLSTLPKILQLSEDLSYEPIDEPAEKGYLEAVKKSDHLAIHLQHLSTPPKRLQLSDDLSYEPIDEPAEKGYLEAVKWSMFSHICTQPVQYNGARIDDSASIVTKAWFEVKGIGMKKVLFLRLGFSTVASAVIRRSEWDGPTMSTRKSGLMSMLISTRFSTGLTEKPELRKKLDLNSAIYPEGPPLPTRAPKMLSFVDTKETVRGPEVPPGYWVVTGAKLCVEGGRIRVKVKYSLLTIMSEDSLFI

SEQ ID NO: 341 - protein, 609 aa, Polypodium formosanum (Cristatum)
MASKPGIPNAAKIAHLAIQSLGRGYDLTCDLRFSSFKDVNGASFIDLKNNETIDLSLPGGVVIANVPAIVKCDKGERTRFRSDILSFDQMSEQFNHGLSLSGKIPCGLFNNMFSFTGSWQKDASTTKHLALDGWFYTLYTVEMPRSQLVLKKDIKASVPSSWEPAALARFIETFGTHIILGVKIGGKDVVYMKQHQSSPSTSIEFQKLLAEVSDERFLQTEGRASVGSKNSHSNKKHNIEFQSWSAHLDTFSQNIYSEKKHHVTIVPRRKGGYDHGQGHSDWIHTVPLAPDVISVSLIPITFLLHGVSGSGFLSHAVNLYLRYNPPIEELRQFLEFQLPREWAPVYSELPLTLPRREPSLSTLQFTFLGPKLKVCKLEVAVGKKPVTGMRLFLEGKRCDKLAIHLQHLSAIPRFLQPLWEDHPFAKEITWQDPDDYSTKYFEPVQWKNFSHICTAPVENTETWIGDHAGASVVVGAQLAVKSFGLRNVLYLRLLYSKIPEAKIRRSEWDHMPALAQKSGMFSSFLSTTFSSTPAPPKAPAVVINSGIYPEGPPKPVRDPKLLKFVDTTEMTKGPQDMPGHWLVTGAKLYLDKRKISLRVKYSLLTISSD

SEQ ID NO: 342 - protein, 515 aa, Prostanthera rotundifolia
MSEQLNQELSLTGKIPSGLFNAMFEFSGCWQKDAAYTKTLAFDGMFITLYTVALEKSQMVLKDHVKKEVPSSWEPAALARFISKFGTHVVVGVKMGGKDVIYVKQQHGSSLQPADVQKRLKLMADKRFLDANGQNELGSEQIYQNEKFEMKETRLRFADTGTSSSYSHKDDIISICKRRGGSDGVNLTHNEWLQTVLLEPDVISMSFIPVTSLLTGVSGSGYLSHAINLYLRYKPPIEELHQFLEFQLPRQWAPIFSDLPLGPQRRRQNTASLQFSLMGPKLFINTTAVDVGKRPVTGLRLYLEGKRSNRLAIHLQHLSSLPNIFQLEDDPNGNFRQESYDRKYYEKVQWKNFSHICTAPVESDEELSIVTGAQLQVGDYGFKKVLFLRLHFSSVKGAISVKYPEWDGSPGLARKSGLISTLISHHFTAVQKPPPQPADVNINSAVYPGGPPVPIQTPKLLKFVDTTEMTRGPQEPPGYWVVSGARLVVEKGKISLRVKYSLLTVIQPDDDLLPE

SEQ ID NO: 343 - protein, 607 aa, Marsilea mutica
MTTTTSRPNSVATAEQAVRCLGKGYDVVNDLWFRYCKGDDRLIEIDQSRPSQELVLPGNITLSEIPACVKCDQGDLTRFATDVISFNEMSEHFNKSLSITGKIPLGHFNSMFQFSGSWQKDASSVKALAYDGVFKSLYSLQMPTTLLTLKEEVKASMPSSWDPRALANFIENYGTHIIVGVTIGGRDVVCLKQLHGSSLSGDRVRKFLESSANERFLASGVSSHNAKGNSHKDDIGYNFINNVAMNEETILKDDMVNIIRKQRGGKQCLQSHKEWLQTVKDFPDILSMHFVPITSLLTGVTGSGFLNHAINLYLRYKPPIEELRYFLEFQLPKEWAPAFGDLPLGPPRKQIESPALQFRFMGPKLQVNTTQVTVGKRPVTGIRLHLEGVKGNRLAIHLQYLTVVPQILQPLLEENKDIEGQWHGPESDGDYSKYFEPVMWKSFSHVCTAPVETIDAWSEEDVDATIVTGAQLRVEQHGTKKVLVLWLLYTKIPKVGIRRPEWDHSPASQQKSGIFSTLLSTTFSSQQAQTVNKPAVQVNINSAINPYGPPTAKTHSPKLLKLVDTNEMTRGPTCQPGHWLVTGAKLAVENGKIAIKPKYSLLMYRTE

SEQ ID NO: 344 - protein, 506 aa, Waldsteinia ternata
MRPVSNAASIKCLGVDGYFIVFFSVHINRSPLVLADEVRDSVPSSWDPVAISRFIENYGTHIVVGLSVGGQDVMLVKQDKSSDLGPSELKKHLNELGDQHFTGTCSFSPLHSKTKDHKHRLTPQAFNVFDAPQSVAINGFSTAHTKDGITVISSKKGGDPSASSHSEWLLTVPSRPDAIHFSFIPITSLLKGVPGKGFLSQAINLYLRYKPPIADLPYFLEFQVSHKIWAPMHNDLRLGPATNSKSNPSSPAIYFSLMGPKLYVNTTQVKVGNCAPVTGMRLFLEGMKCNRLAIHLQHLANTPLMLENKIDDTSSWRGSEEVTDHGYFEAINGNKFSHVCTAPVLYDLEWTSPSSINSAFIVSGAQLVVKQHGSKSVLHLRLLFSKVLDYFIVQSVWGESSCSSSRSSSSSGLLDAISRPVSGGYWAKEKVEPAGEQVILDSSVFPAGPPVPLPSQKFVKYVNTSHVCKGPQNSPGHWLVTGARLNLVQGKIGLQVEFSLLNAVEY

SEQ ID NO: 345 - protein, 521 aa, Adiantum pedatum
MSEHFNQGLSLSGKIPCGFFNNMFNFSGLWQKDASTTRHLALDGWFYTLYTVEIPRSQLVLKEDIKALVPASWEPVALARFIETFGTHIIVGAKIGGKDVIYMKQHQSSPATSVEFQKLLAQVSDERFLQNEGRTSVGSVDNRSHKKPTIEFQSWSAHLDTFSQIVYNDKHHVTIMPRRKGGVDHGQSHSEWIHTVPLSPDIISVSLVPITFLLSGVAGSGFLSHAVNLYLRYKPPVEELRQFLEFQLPREWAPVFSDLPLTLSRKEHSPSTLQFALLGPKLKVSKMQVTVGKKPVTGMRLYLEGKKCDKIAIHLQHLSAIPRFLQPLWEDHPFAGEATWQDPDDYSTKYFEPVQWKNFSHVCTAPVESTETWIGDHAGASVVIGAQLAVKSFGLKNVLYVRLLYSRIPEARIRRSEWDHMPATTQKSGMFSTLLSTTFSSTAAPALAKASPVVLNSGIYPDGPPKPVQDPKLLKFVDTTEMTKGPQDMPGHWLVTGAKLYLDKKRISMRAKYSLLTVGSD

SEQ ID NO: 346 - protein, 342 aa, Bignonia chamberlaynii (Bureau)
MAYYSSSNVRMDPQLAAEKAVSVIGFGYDLTSDIRLSACKPGPSGSGLIELDRTRRKDLVVPGNVVVPNVSASIKCDKGERTRFSCDALSFSQMSEHFNQELSLSGKIPSGMFNAMFGFKGCWQSDASTTKILAFDGWFISLYRIELERSQITLSDKVKQEVPTTWDPAALAEFIDKYGTHVVVGVKMGGKDVIHIKQLQNSNLQPTEVQKLLKQLADERFCEDGNRNSVANANVSSGKPKVEQSMMWDLPLPFASTVRPPIVSHSKNNDLLSIHIRRGGLDVGQSHNQWLSTVSQHPNVISLSFVPIASLLSGIRGSGFLSHAINLYLRCEYNKLIQDLLR

SEQ ID NO: 347 - protein, 621 aa, Nephrolepis cordifolia (Duffii)
MASTKEAAALAAVKALGCGFDLTSDYRLKYKKGPLLHLQHSYTKDLTIPGGITIPDVVRDVKCDKGERIRFASEIMQFQQMSQFFNQNSSIEGKIPLGLFNAMFDLSGSWQDDANRIKNLAFDGCFITLYKLHLTRSNLVLQEEVKNDIPSVWDPQRLAKFIEKYGTHIIVSASIGGQDVLYLKENSSSLLSAQDLHKKLKSAGEEYFSDKGAKGNTSFKDSETSPLNALHSHQFRALAPSAQLFISNKDYTIISQRRGGYFFAKNHCEWQETVNSYPEAISLSFVPITSLNHCEWQETVNSYPEAISLSFVPITSLLLGIAGSGFLQHAINLYLRYKPPVSDLQYFLDFQVPRQWIPIHNELPLRLARKQVFSPSLQFSLTSPKLYVNNNEVVVNRKPVTGVRLYLEGRKSNKLAIHLQHLSVLPQSLGQFWSESTQMELPRWNGSNDAPNDWFEPVEWKCFSHVCTQPIKYKPEWLNERGGAFVVTGARLDVKAHGLKSILHLHLLFSKIPGCTIQRSRWNEHPAAEKAGFFSSISTTFSATTKTGKKGPPVVVDSAIFMEGPPRPIQSPKLLKFVDTTELTKGPQDAPGHWVITAARLELEKSKISLRAKFSLLNYTE

SEQ ID NO: 348 - protein, 635 aa, Stenochiaena tenuifolia
MASVDGGFVAMQAQSSKGMPKNTAFQVAQHAVDSLGRGYDVNADLWLRYCKRSERLIENDDSGPKQDLLLPGNIIIPNVPSSIKCDKGDRMRFTSDVLTFSEMSEQFNQTLSISGKIPVGHFNSMFGFSGSWQKDASQVKTLAMDGVIINLYSVELPREQLTLKEEVRAAVPSSWDPAALASFVEKYGTHVIVGIKIGGKDMICLKQHRSSSLPAVGVQKILEAKAKERFSSVESSAIKEKVNKGKIRDGSTYELNGMNAAFGSTDGMPLSWMNDSAPEIETDDVTVIFKRKGGRDISLSHEDWLHTVPSAPDIVSMSFIPITSLLNGVAGTGFLSHAINHYLRYKPPIQELRYFLEFQLPKEWAPAFGDLPLGPPRKQQDSPSLQFRLMGPKLQVNTTPVFIGKRCVTGLRLHLEGKKSNRLAVHLQYLTVVPQILQRLWEDDQPEEWVGPDDDFSKYFEPVMWKSFSHVCTAPVESNETWVDESRGENALKGALVVTGAQLNVEQHGSKKVLFLRLLYSKIHKATVRRSEWDHTPASQQKSGIFSTLLSTPFSSQAAPVKPVQVVVNSAIYPDGPPAAKSQAPKLLKFVDTTEMTRGPLDLPGHWLVTGAKLFVDRGKIAVRAKYSLLLYSED

SEQ ID NO: 349 - protein, 628 aa, Aglaomorpha (Roberts)
MASAKDAAALAAVEALGCGFDLTSDYRLKYKKGSLLELQRSHNKDLTIPGGITIPDVSRDIKCDKGERMRFASEVMQFQQMSQWFNQNASIEGKIPLGLFNAMFDLSGSWQDDASRLKSLAFDGSFITLYKLHLTRSNLVLREDVKKDIPSVWDPKSLAKFIEKYGTHIIVSASVGGQDVLYLKENDSSLLSAQDIRKKLKSAGDDYFSENSGKRNTDFKDSETLPLNSQPFRGTIAASAQLLISNKDYTVLSQRRGGYYFAKTHCEWQETVNMYPEAISLSFVPITSLVLGAAGSGFLQHAINLYLRYKPPVSDLQYFLDFQVPRQWIPVHNELPLRLARKQAFSPSLQFSLMSPKLYINNNEVVVNKKPVTGIRLYLEGRKNNRSLMSPKLYINNNEVVVNRKPVTGIRLYLEGRKNNRLGIHLQHLSVLPQSLGQFWSEGTQIESPQWNGSNDAPNDWFEPVEWRCFSHVCTQPIKFKSEWLNERDSAFVVTGARLDVKAHGLKSVLHLHLLFSKIPGCTIQRSRWDQHLAAEKTGFFSSISTTFSTTTKAGKKSPQVVVDSAVFMGGPPRPIQSPKLLKFVDTAELIKGPQDAPGHWVVTAARLELDRGKIAIKVKFSLLNYAE

SEQ ID NO: 350 - protein, 296 aa, Tupidanthus calyptratus
MSSSTSTSSSSSSSGDGIVWRAINSLGKGFDLTSDFRLKYCKGNHPLVLLNQTHTKQLLVPGFGYFNHVSSDINCGKGERTRYQSDILDFNQMSEFMNQRSSVPGKIPSGLFNSMFGFESESWAKEAASTKCLGLDAYFISLFHLRINRYPLVLCDEVRNAVPSTWDPSALARFIEKYGTHIIVSLGIGGQDTVVVRQDKSSNLEASDLKKYLDQLGDQLFTGTCTFTPKDQQRKGVKVIFSKRGGDISANTHSEWLLTVPSMPDAVNFCFIPITSLRGMQRLYITCHQPLSLFWK

SEQ ID NO: 351 - protein, 346 aa, Symphoricarpos x chenaultii (Hancock)
MLSIHIRRGGIDNCQSHNQWLSTVSRSPNVISMSFVPIASLLSGVRGSGFLSHAINLYLRYKPPIEELQQFLEFQLPRQWAPAYGDLPLASRRKKQPSPALQFTFMGPKLYVNTVKVDSGNRPVTGVRLYLEGKKSDHLAIHLQHLSTLPEILQLSDDLSYEPIDEPVERGYFEPVKWSIFSHICTAPVQYNGARIDESASIVTKAWFEVKAVGMKKVLFLRLGFSMVASARIRRSEWDGPTSSSRKSGLISMLISTPFSTGLNQQQKKPEKVDLNSAVYPGGPPLPTRAPKMSHFVDTKEMVRGPEDPPGYWVVTGAKLCVEGGRIRIKVKYSLLTIISDDSLFM

SEQ ID NO: 352 - protein, 610 aa, Celosia argentea (Sylphid)
MEDWWEEREKKPIELRAVEALGLGFDLTSDFRLKFAKKERLVVLDEAHKRDVVIPGANVSIPGVSVDIRCDKGEQLRFKSDVLQFNQMSELLNQRSSVQGKVPSGYFNAIFNFSGAWLNDATECKHLAFDGYFVALYHLHLMASSIVLQEKVKKSVPSHWDPASLSRFIQKYGTHIIVGLAVGGQDLICVRQTPSSEIPPAELRAHLEDVGDALFSDGKDPLLQRKARDGKQKAPEVFRRILQSNIIQLTSVVETSNKDGLSVIRSRRGGDVFLHSHSQWLQTVPSHPDAIHFKFVPITSLLTGIPGSGYLSHAINLYLRYKPAPEDLQYFLEFQVPRQWAPMYNELPLQHRRMTTSSSLLQFSLMGPKIHVNSTKVLSSLKPIVGLRLYLEGKNCNHLAIHAQHLTTLPNSMAFSSPHEHSQWRGSDEFDPEGQFLEPIRWKRFSRVCTSIVKHDPNWLQGKTTGVYIVTGAQLLAKGRWPKTVLHLRLLFSHLPNCTIRKTEWAAAPQGSHKTSILMTLSTTFTFTQKQNNSPPKKLPAALNSGVYPNGPPVPVKCEKLLKYVDASEVLRGPHDAPGHWLVTAAKLVTDGGKIGLHVKFALIDYTNDL

SEQ ID NO: 353 - protein, 601 aa, Adiantum trapeziforme var braziliense
MASEREAARTAALVAVESLGCGFDLTSDYRLKYRKGPLVQLQHNSNKDLTIPGGITIPEVSRDVKCDKGERMRFASEVMQFQQMSQWFNQNASVEGKIPLGLFNAMFDLSGSWQDDASQIKNLAFDGCFITLYKLHLTRSNLVLRDDVINDVPSVWDPQALARFIEKYGTHIIVSASVGGQDVLYLKENQSSLLSPKDIHKQLKSAGDDYFLDKDADRILNVKDSETLPLNSLKSQPSRATVAHIHSSHLFIRNKDFTLISQRRGGHYFSKSHSEWQETVNVFPEAISLSFVPITSLLLGVAGCGFLQHAINLYLRYKPPVSDIQYFLDFQVPRQWIPIHNELPLRLARKQGFSPSLQFSFMGPKLYINSSEVVVARKPVTGLRLFLEGRKSNRLAIHLQHLSVLPQSLGKFWSEDTYKDLQRWNGSNDAAKDWFEPVEWKCFSHVCTQPVKYKPEWLDVKGSAFVVTGARLEVQVHGLKSVLHLHLLFSKIPGCVIQRSRWDQPPATEKTSFFSSLSTTFSSAAKPGKKGPPVVVDSAVFVGGPPRPIQSPTLLKYVDTTELTRGPQDAPGHWVVTAARLELDKSKISLRVKFSLLSYLD

SEQ ID NO: 354 - protein, 648 aa, Tupidanthus calyptratus
MAFNANRFDPQSAAEKAVSAIGSGYDLTVDIRLSECKPGPSGSGLIELDRTLTKDLNLPCGRVVRNVSPSIKCGKGEQTRFHSDVLTFVQMSEQFNQDISLSGKIPSGLFNAMFDFKGCWQKDAATTKSLAFDGWFFSMYNIELARSQITLSEQVKKEVPSSWDPAALAEFIEKYGTHIVVGVKMGGKDVIHLKQLQNSNLQPTEVQKLLKQLADERFSEDVNGSLIPNPEKSSGKQKEEPSIVQDLNLPFANLLRQAVVSQSKNDDLLSIRIRRGGFDTGQSHKQWLSTVSQFPNAISMSFVPLASLLSGIRGSGFLSHAINLYLRYKPPMEELEQFLEFQVPRQWAPVYGDLPLAPRRKKQASPSLKFTFMGPRLYVNTIRVDSENRPVTGIRLYLEGKKSDHLAIHLQHLSTLPKILQLSEDLSYEPIDEPAEKGYLEAVKWSIFSHVCTQPVQYTPKRLQLSDDLSYEPIDEPAEKGYLEAVKWSMFSHICTQPVQYNGARIDDSASIVTKAWFEVKGIGMKKVLFLRLGFSTVASAVIRRSEWDGPTMSTRKSGLMSMLISTRFSTGLTEKPELRKKLDLNSAIYPGGPPLPTKAPKMSSFVDTKEMVRGPEDPPGYWMVTGRAHPCQQEPQKCCLLWIRKKR

SEQ ID NO: 355 - protein, 265 aa, Tupidanthus calyptratus
MEEEGGKPIEVIAMESLGLGFDFASDFKLKFAKRCPDGAGDDGRLVVIDEANKRDVVFPGGGVIRGVPESIRCGKGDRIRFKSDVLKFNQMSELINQKSSVQGKVPSGYFNAMFDLSGSWFNDAADSNHLAFDGYFITLYCLHLTASPLVLRDKVKKSVPSHWNPASLSRFILTYGTHIIVGLAVGGQDVICVKQRPSSGIPPAELRGYLEDLGDCMFSDGRNPVLERKTRDGKQKVPEVFNRMLQSHTMQFSSITETSSKDVRL

SEQ ID NO: 356 - protein, 678 aa, Lygodium japonicum
MKPAAATIRPNFFTSSSSSAPSDPASVAKQAVDALGRGYDVTGDLWLSKCREPLIVDLAESSPTQDLAIPGGISLPCVPAPIKCDKGDRTRFASDILSFSEMSEQFNKTLSIAGKIPLGLFNSMFGFTGLWQKDASSTKTLGLDGVFINLYSVEVPRTHLTLREEVRKAVPSSWDPAALASFVEKYGTHVIVGVKIGGKDVVYIKQRHSSTLSGVSIQKILETKALERFSSGETCTSKEKLTKGKHSSTLSAVSIQKILETKALERFSSGETCTSKEKLTKGKDFQTKGIHGAEPNGQNGNLLRGHVDGIENSESFSLMEDSSTFSVDGDVTVIYKRKGGRESCQSHNDWLHTVPLAPDVVSMSFVPITTLLNGVPGTGFLSHAINLYLRYKPPLQELSNFLEFQLPKEWAPAFGDLPLGPPRKQQEVPSLQFRLMGPKLHINTTPVVVGKRPVTGLRLYLEGKKSNRLAIHLQYLTAVPQILKTLWVEDGGGEEEWVGPEEDFSKYLEPVQWRNFSHVCTAPVENSETWLGGPGGALVVVGARLQVQQYGAKKVLFLHLLYSRIAKARIRRSEWDHMPASQQKSGLFSTLISTTFSSAAAQSPAPPKPVVINSAIYPEGPPVPGQMPKLLKFVDTTEMTRGPHDLPGHWLVTGAKLLLERGKISLRAKYSLLLYSVE

SEQ ID NO: 357 - protein, 608 aa, Platycerium wandae
MASKLDIPNAAKVAHLAIQSLGRGYDLTCDLRFSSFKDRNGTSLIELRNDETVKLSLPGGVVIADVPAIMKCDKGERTRFQSDILTFEQMCQQFNQGLSLSGKVPCGLFNNVFNFTGSWQKDASTTKHLALDGWFYTLYTIEMPRSQLVLKENIKSSVPTYWEPAALARFIETFGTHIIVGVQIGGKDVVYMKQHQTSPSTPIEFQKLLTEVSNERFLQTEGRASIGSKDSRSNKKRNVEFQSWSAHLDTFSQMIYNEKHHVTIIPRRKGGFDHGQSHSEWIHTVPLAPDVISVSLIPITFLLHGVAGSGFLSHAVNLYLRYNPPIEELRQFLEFQLPRAWAPVYGELPLTLPRRESSLPTLQFRLMGPKLKVSKLEVAVGKKPVTGMRLFLEGKRCDKLAIHLQHLSAIPKFLQPLWENHPFGREVTWQDPDDYSTKYFEPVQWKNFSHVCTAPVENTETWIGDHAGASVVVGAQLAVKSFGLRNVLYLRLLYSKIPEAKIRRSEWDHMPASTQKSGMFSSFLSTTFSTTPVPPKVPAVVINSGIYPEGPPRPVRDPKLLKFVDTTEMTKGPQDMPGHWLVTGAKLYLDKRKISLRVKYSLLTVSSD

SEQ ID NO: 358 - protein, 623 aa, Aglaomorpha (Roberts)
MASAKDAAALAAVEALGCGFDLTSDYRLKYKKGSLLELQRSHNKDLTIPGGITIPDVSRDIKCDKGERMRFASEVMQFQQMSQWFNQNASIEGKIPLGLFNAMFDLSGSWQDDASRLKSLAFDGSFITLYKLHLTRSNLVLREDVKKDIPSVWDPKSLAKFIEKYGTHIIVSASVGGQDVLYLKENDSSLLSAQDIRKKLKSAGDDYFSENSGKRNADFKDSDSSLLSAQDIRKKLKSAGDDYFSENSGKRNTDFKDSETLPLNSQPFRGTIAASAQLLISNKDYTVLSQRRGGYYFAKTHCEWQETVNMYPEAISLSFVPITSLVLGAAGSGFLQHAINLYLRYKPPVSDLQYFLDFQVPRQWIPVHNELPLRLARKQAFSPSLQFSLMSPKLYINNNEVVVNKKPVTGIRLYLEGRKNNRLGIHLQHLSVLPQSLGQFWSEGTQIESPQWNGSNDAPNDWFEPVEWRCFSHVCTQPIKFKSEWLNERDSAFVVTGARLDVKAHGLKSVLHLHLLFSKIPGCTIQRSRWDQHLAAEKTGFFSSISTTFSTTTKAGKKSPQVVVDSAVFMGGPPRPIQSPKLLKFVDTAELIKGPQDAPGHWVVLIAELCRVESEDIVLLQGS

SEQ ID NO: 359 - protein, 335 aa, Waldsteinia ternata
MRMEEATTEKPIEVRALEALGQGFDLSSDFRLKFAKGLDGSKGRLVVLNEESKRDIVIPSGSGGGVVIHGVPQDIHCDKGDRIRFKSDVLEFNQMSELLNQKSSVQGKIPSGYLNSIFGLSGDWLQDAAETKYLAFDGFFISLYNLHLTASPLVLRNKVQKSVPSRWDPAALSRFIHSYGTHIIVGMAVGGQDLVCVRQKSSSPVPPADLRRNLEDLGDFLFSDGPSLLRGKTRNGKQKIPEVFDRILQSNTMQLTTISETSSKDGLTVVCSKRGGDVFLNSHSNWLQTVLAEPEAIIFKFVPITSLLTGLPGSGYLSHAINLYLRCKYSTPYQN

SEQ ID NO: 360 - protein, 639 aa, Polystichium tsus-simense
MASAVGALPLQSSEAAPSQNIPSLAFSVAQQAVDALGHGYDVNSDLWLRYCKRGERLIENDKSGPTQDLLLPGNIAIPNVPTSVKCDKGDRTRFTSDILTFNEMSEQFNQNLSISGKIPVGHFNAMFGFSGSWQKDASLVKNLAMDGVFINLYSVELPRAQLTLKEEVRAAVPSSWDPAALASFVEKYGTHVIVGVKIGGKDVICLKQHRSSSLSAVGVQKILQSKAKERFSSVDGCAAKEKINKGKIRDGSTYGSNGMNAVNGLKDGIPLPWISDSSTDLSAVETDDVTVLFKRKGGRDVQSHDEWLHTVASAPDIVSMSFVPITSLLNGITGTGFLSHAINHYLRYKPQIQELHHFLEFQLPKEWAPAFGDLPLGPPRKQAGSPSLQFRMMGPKLQVNTTPVVIGKRCVTGLRLHLEGKKSNRLAVHLQYLTVVPQILQQLWEDDQPEQWEGPEDDFSKYFEPVMWKSFSHVCTAPVESSETWEDEGRGEAGPKGALVVTGAQLDVEQYGSKKVLFLRLLYSKIHKARIRRSEWDHTPASQQRSGLFSTLMSTTFSSAQSAPQKAVQVVVNSAIYPQGPPPAKSQAPKLLKFVDTTEMTRGPLDLPGHWLVTGAKLFVDRGKIAVRAKYSLLLYTVD

SEQ ID NO: 361 - protein, 279 aa, Tupidanthus calyptratus
MAFNANRFDPQSAAEKAVSAIGSGYDLTVDIRLSECKPGPSGSGLIELDRTLTKDLNLPCGRVVRNVSPSIKCGKGEQTRFHSDVLTFVQMSEQFNQDISLSGKIPSGLFNAMFDFKGCWQKDAATTKSLAFDGWFFSMYNIELARSQITLSEQVKKEVPSSWDPAALAEFIEKYGTHIVVGVKMGGKDVIHLKQLQNSNLQPTEVQKLLKQLADERFSEDVNGSLIPNPEKSSGKQKEEPSIVQDLNLPFANLLRQAVVSQRRNHLLSRISICHLQTC

SEQ ID NO: 362 - protein, 604 aa, Verbascum chaixii (Vill)
MAMKSVEMRATEALGQGFDLASDFRLKFVKKCPNGGRLLLLNEQNKRDVVVPGGVTIPDVPECIRVDKGDHIRFKSDVLQFNQMSELLNQKSSIPGKVPSGYLNAIFDLTGTWLNDAADAKHLAFDGYFISLYYLHLTASPLVLHDHVKKSVPSRWDPAALSRFIQTYGTHIVVGMAVGGQDLLCVKQRPSSPIPPAELKGYLEELGDCLFSDANSPMLERRAKDNKNKVPEVFNRMLQAHTMQFTSITETSSKDGLTLIWSKRGGDVFAQSHSRWLQTMSANPEALLFKFVPITSLLNGIPGSGYLSHAINLYLRYKPTIEDLPYFLEFQVPSQWAPLFCELPLRHQRRKTSFPSLQFSFLGPKMYVSSTQVTSDQKPVVGLRLYLEGKKSNRLAIHVQHLSSLPNIMALGSTTLKPQWRGSDDYESHDQFLEAVRWKRYSNVCTSIVKHDPTWESNGGVFIVTGAQLVIKGKWPSKVLHLRLLYTHIPNCSIRKTDWASSPEASHKSSFLTNLSSTFTFTQRAVADAPKQLPATLNSGVYPDGPPVPIRSTKLLKYVDPTEVARGPYDTPGHWLVTAAKLVPEGGKIGLHVKFALLDYSQEA

SEQ ID NO: 363 - protein, 593 aa, Campyloneurum angustifolium
MAGTKDAAALAAVEALGCGFDLTSDYRLKYKKGRLLQLQHSHNKDLTIPGGITIPDVSRDIKCDKGERMRFASEVMQFQQMSQWFNQNASIEGKIPLGLFNAMFDLSGSWQDDANRLKNLAFDGCFITLYKLHLTRSNLVLREEVKNDIPSVWDPKSLAKFIEKYGTHIIVSASVGGQDVLYLKENYSSLLSAQDIHKKLKSAGDEYFYENSGKRNADFKDNETSPLNSQPFRGTIAASAQLLISNKDYTVISQRRGGYYFAKTHHEWQETVNIYPEAISLSFVPITSLLLGAAGSGFLQHAVNLYLRYKPPVSDLYYFLDFQVPRQWIPVHNELPLRLARKQTFAPSLQFSLMSPKLYINNTEVVVNRKPVTGIRLYLEGRKNNRLGIHLQHLSVLPQSLGQFWSEGTQIEPPQWNGSNDAPNDWFEPVEWRCFSHVCTQPIKIKPEWLNEGGSAFIVTGARLDVKAHGLKSVLHLHLLFSKIPGCTIQRSRWDQHQAAEKTGFFSSISTTFSTTTKAGKKSPQVVVDSAVFMGGPPRPIQSPKLLKFVDTAELTKGPQDAPGHWVVTAARLELDRGKISIKVKFSLLNYAE

SEQ ID NO: 364 - protein, 380 aa, Asplenium prolongatum x Asplenium antiquum (Kurata)
MNAVNGSKDGLSLSWMNDSLSDLLTVETADVKVMFKRKGGKDVSQSHEEWLHTVPAAPDIVSMSFVPITSLLNGVMGTGFLSHAINHFLRYKPSIAELRHFLEFQLPKEWAPAFGDLPLGPPRKQQASPSLQFRLMGPKLQVNTMPVVVGKRCVTGIRLHLEGKKSNRLAIHLQYLTAVPQILQGLWEDYQPEKWEGPDTDFSRYFEPVLWRSFSHVCTAPVESKEPWVDEMRGEPVLKGALVVTGAQLDVEQHGSKKVLFLRLLYSKIRKVRIRRSEWDHMPASQQRSGIFSTLISTHFSSAPSSPSKPVQVNSAIYPDGPPPANSQAPKLLKFVDTSAMTRGPLDLPGHWLVTGAKLDVERGKIAVRAKYSLLLYGAD

SEQ ID NO: 365 - protein, 599 aa, Bignonia chamberlaynii (Bureau)
MALRLPAGEAAKVAIHSIGHGYDISLDLRLKYCKGDSCLIEVDEDQGREIVLPGGISIQNVSKSIKCDKGERTRFRSDVLTFQQMSEQFNQELSLTGKIPSGLFNSMFEFSGCWQKDAAYTKALAFDGMFITLYTVALEKSQMVLKDHVKKEVPSSWEPAALARFINKFGTHVIVGVKMGGKDVIYVKQQHSSSLQPADVQKRLKVMADKRYLDANGQHELDSEQIYQNQKFDMKETRLRFADTGTSSSYSHKDEIISICKRRGGSDVTNLTHNEWLQTVLLEPDVISMSFIPITSLLNGVSGSGYLSHAINLYLRYKPPIEELHQFLEFQLPRQWAPVFSDLPLGPQRRQQNTASLQFSLMGPKLFVNTTAVDVGKRPVTGLRLYLEGKRSNRLAIHLQHLSSLPNIFQLKDDPNGNFCQESYDRRYYEKVQWKNFSHVCTAPVESDEELSIVTGAQLQVGDYGFKKILFLRLRFSTVIGAVSVKYPEWDGSPGLARKSGLISTLISHHFTAVQKPPPQPADVNINSAVYPGGPPVPTQTPKLLKFVDTTEMTRGPQEPPGYWIVSGARLVVEKGRISLRVKYSLLTVIQPDDDDVLD

SEQ ID NO: 366 - protein, 339 aa, Waldsteinia ternata
MALPAYRMDPQAAAEKAVAAIGSGYDLCLDLRLTSCKSGLVDLDPTRTRDLVLPGGAVVSDVSTSIKCDKGERTKFRSDVVSFNQMSEQYNKELSLSGKIPSGLFNAMFNYSGCWQKDAAPTKYLAFDGWLITLYSIELARSQLRLSEQVKRDVPSLWDPAALAAFIEKYGTHIIVGVKMGGKDIVHIKQLQNSKLEPAELQRRLKQVAEERFSDDANETSASNPTADLFGMMKDDNPLHWDIQRTLASSIKPPIVTHSMDDDVVTISVRRGGVDIGQSHNQWLSTISQAPNVISMSFVPITSLLGGTQGNGFLIHAVNLYLRCECLFFFSSISTWYVY

SEQ ID NO: 367 - protein, 611 aa, Adiantum raddianum (Pacific Maid)
MASKHETAKAAKVARLAINTLGRGYDLTCDLRFTSCKDADGTPLIEINDEETHELTLPGGIVVGNVPTAVKTDKGERTRFRSDILTFDQMSQQFNQGLSLSGKIPCGLFNNMFSFTGLWQKDASTTKHLALDGWFYTLYTLEIPRSQLMLKEEIKALVPSSWEPAALARFIETFGTHIIVGVKIGGKDVIYMKQHQSSPSTSVEFQKLLAEVSDERFSQSEGRASVGSVDNRSQKKHSVEFQSWSAHLDTFSHIVHNDKHHVTIIPRRKGGIDHGHSHSEWIQTVPLAPDIISVSLVPITFLLSGVAGSGFLSHAANLYLRYKPPIEELRQFLEFQLPREWAPVFSDLPLTLSRKERSPSTLQFTLMGPKLKVSKMQVAVGKKPVTGMRLYLEGKKCDKIAIHLQHLSAIPRFLQPLWEEHPFAGEATWQDPDDDSTKYFEPVQWKNFSHVCTAPVENTETWIGDHAGASVVVGAQLAVQSFGLKNVLKLRLLYSRIPEARIRRSEWDHMPSATQKSGMFSTFFSTTFSSAAASAPAKASPVVLNSGIYPEGPPKPVHDPKLMKFVDTTEMTKGPQDMPGHWLVTGAKLYLDRKRISMRVKYSLLTIGSLD

SEQ ID NO: 368 - protein, 640 aa, Lygodium japonicum
MKPAAATIRPNFFTSSSSSAPSDPASVAKQAVDALGRGYDVTGDLWLSKCREPLIVDLAESSPTQDLAIPGGISLPCVPAPIKCDKGDRTRFASDILSFSEMSEQFNKTLSIAGKIPLGLFNSMFGFTGLWQKDASSTKTLGLDGVFINLYSVEVPRTHLTLREEVRKAVPSSWDPAALASFVEKYGTHVIVGVKIGGKDVVYIKQRHSSTLSGVSIQKILETKALERFSSGETCTSKEKLTKGKDFQTKGIHGAEPNGQNGNLLRGHVDGIENSESFSLMEDSSTFSVDGDVTVIYKRKGGRESCQSHNDWLHTVPLAPDVVSMSFVPITTLLNGVPGTGFLSHAINLYLRYKPPLQELSNFLEFQLPKEWAPAFGDLPLGPPRKQQEVPSLQFRLMGPKLHINTTPVVVGKRPVTGLRLYLEGKKSNRLAIHLQYLTAVPQILKTLWVEDGGGEEEWVGPEEDFSKYLEPVQWRNFSHVCTAPVENSETWLGGPGGALVVVGARLQVQQYGAKKVLFLHLLYSRIAKARIRRSEWDHMPASQQKSGLFSTLISTTFSSAAAQSPAPPKPVVINSAIYPEGPPVPGQMPKLLKFVDTTEMTRGPHDLPGHWLVTGAKLLLERGKISLRAKYSLLLYSVE

SEQ ID NO: 369 - protein, 610 aa, Asplenium nidus var plicatum
MASKHDIPNAARVANLAFQSLGRGFDLTCDLRFSSCKDVHGAPLIELSDKDLRKVSLPGGVVVPNVPTIVKCDKGEQTHFRSDILTFDQMSQEFNHGLSLSGKVPSGLFNHMFNFTGSWQKDASATRHLALDGWFYTLYTLEMPRSQLALKEDIKAAIPTSWEPAALARFIETFGTHIIIGAKIGGKDVVYLKQHQVSTSTLADFQKLLAEVSEERFSETEGRASVGSKDSHSNNKRSMQFKSWTARLDTFSQIIYNDKHHVTIIPRRKGGFDHGQSHSDWVHTVPLAPDVISVSLVPITSLLNGVPGSGFLSHAVNLYLRYKPPTEELRQFLEFQLPREWAPVFSELPLTLSRREQSPSTLQFTLMGPKLKVNKLQVTIGRRPVTGMRLFLEGKRCDRLSIHLQHLSAMPRFLTSFWEDHPFAREATWQDPDDYSTKYFEPLQWKNFSHICTAPVENTETWIGDHAGASVVVGAQLAVKSYKLRNVLYLRLLYSKIPEAKIRRSEWDHVPASAQKSGMFSSFFSTTFSSTVVPGAARAPAVVINSGVYPEGPPKPVQDPKLLKFVDTTEMTKGPQDMPGHWLVTGAKLYLDRRKISLRVKYSLLTVSLD

SEQ ID NO: 370 - protein, 539 aa, Lygodium flexuosum
MSEQFNKTLSIAGKIPLGLFNSMFGFTGLWQKDASSTKTLALDGVFINLYSVEVPRTHLTLREEVRKAVPSSWDPAALASFVDKYGTHVIVGVKIGGKDVIYVKQRHSSPLSAVSIQKILETKAVERFSSGETCTSKEKLTKGKDFQTKGIHGAEPNGQNGNLLRGHVDGMENSESFSLMEDSSTFSIDGDVTVIYKRKGGSESCQSHNDWLHTVPLAPDVVSMSFVPITTLLNGVPGTGFLSHAINLYLRYKPPLQELSNFLEFQLPKEWAPAFGDLPLGPPRKQQEVPSLQFRLMGPKLHINTTPVVVGKRPVTGLRLYLEGKKSNKLAIHLQYLTAVPQILKTLWVEDGGGEEEWVGPEADFSKYLEPVQWRNFSHVCTAPVENSETWLGGPGGALVVVGARLQVQQYGAKKVLFLHLLYSRIAKARIRRSEWDHMPASQQKSGLFSTLISTTFSSAAAQSPAPPKPVVINSAIYPEGPPVPGQMPKLLKFVDTTEMTRGPHDLPGHWLVTGAKLLLERGKISLRAKYSLLLYSVE

SEQ ID NO: 371 - protein, 597 aa, Asplenium nidus var plicatum
MASGKDAVVLAAVESLGCGFDLTSDYRLKYKKSPLLHLQHSNKKDLTIPGGITIPDVSRDIKCDKGERIRFTSEVMQFQQMSQWFNQNSSVEGKIPLGLFNAMFDLSGSWQDDASQIKNLAFDGFFITLYKLHLARSNLVLCEEVKNDIPSVWDPKSLAKFIEKYGTHIIVSASVGGQDVLYLKENYSSPLSAQDVHKNLKSVGDDYFADRAQRSTNYKDSETLPLNALNSQTFRPTVAHINSAQVLHSCKDFTIISQRRGGYLFAKTHCGWQETVNMFPDAISLSFVPITSLLLGVAGSGFLQHAINLYLRYKPPVSDIQYFLDFQVPRQWIPVHNELPLRLTGRQPFSPSLQFSFMSPKLYVNNNEVVVDRKPLTGIRLYLEGRKSNRLAIHLQHLSVLPQSLGQLWSDSTKSEAHLWNSSADAPREWHEPVMWKCFSHVCTQPIKYKREWSAGHESVFIVTGARLEVKAHGLKSVLHLHLLFSRISGCTIQRSRWHQHQTAEKAGFFSTLSTTFSSTAKTGKKGPPAVVDSAVYIGGPPRPIESPKLLKYVDTAELTKGPQDAPGHWVVTAARLDLEGGKIMLSVKFSLLNYTE

SEQ ID NO: 372 - protein, 597 aa, Asplenium prolongatum x Asplenium antiquum (Kurata)
MASGKDAVVLAAVESLGCGFDLTSDYRLKYKKGPLLHLQHSNKKDLTISGGITIPDVSRDIKCDKGERIRFTSEVMQFQQMSQLFNQNSSVEGKIPLGLFNAMFDLSGSWQDDASQIKNLAFDGFFITLYKLHLARSNLVLREEVKNDIPSVWDPESLAKFIEKYGTHIIVSASVGGQDVLYLKENYSSPLSAQDVHKNLKSVGDDYFSDRAQKSTNFKDSETLPLNGLNSQTFRPTVAHIHSAQVLHSCKDFTIISQRRGGYLFAKTHCGWQETVNMFPDAISLSFVPITSLLLGVAGSGFLQHAINLYLRYKPPVSDIQYFLDFQVPRQWIPVHNELPLRLTGRQSFWPSLQFSFMSPKLYVNNNEVVVDRKPVTGIRLYLEGRKSNRLAIHLQHLSVLPQSLGQLWSDGTKLESHLWNGSADAPREWHEPVMWKCFSHVCTQPIKYKREWSTDHDSVFIVTGARLEVKAHGLKSVLHLHLLFSKISGCTIQRSRWYQNQTAEKTGFFSTLSTTFSSTAKAGKKGPPAVVDSAVYIGGPPRPIESPKLLKYVDTAELTKGPQDAPGHWVVTAARLDLEGGKIMLRVKFSLLNYAE

SEQ ID NO: 373 - protein, 640 aa, Asplenium australasicum
MASAVGRFAATQAQSSEAAQPQITSSPAFSIAQQAVDALGRGYNVNLDLSLSYCKQGKRLIEIDESGPTQDLLLPGNIIIPNMPASIKCDKGDRTRFTTEVLKFNEMSEQFNQNLSISGKIPTGHFNTMFNFSGSWQKDASQVKTLALDGFFINLYTVELPRAQLTLKEEVRAAVPSSWDPAALASFVEKYGTHVIVGVKIGGKDVICLRQHHSSQLSAVGVQKILEAKAKERFTSIAGGTSRENNKGKIRDGFTYGSNAMIAVNGSKDGVHPSWLNSSLSDLPPVETDDVKVMFKRKGGKAVSQSHEEWLHTVPSSPDIVSMSFVPITSLLNGVTGTGFLSHAINHYLRYKPPIDQLRHFLEFQLPKDWAPAFGDLPLGPPRKQQASPSLQFRLMGPKLQVNTMPVVVGKRCVTGIRLHLEGKKSNRLAIHLQYLTAVPQILQGLWEDHRPDNWEGPDTDFSRYFEPVMWRSFSHVCTAPVESKEPWVDEMKGEPVLKGALVVTGAQLDVQQHGSKKVLFLRLLYSKIRKVRIRRSEWDHTPASQQRSGIFSTLISTHFSSAPSPLSKPVQVNSAIYPDGPPLANSQAPKLLKFVDTSAMTRGPLDLPGHWLVTGAKLCVERGKIAVRAKYSLLLYSED

SEQ ID NO: 374 - protein, 600 aa, Asplenium antiquum (Crissie)
MASAVAGLAAMQAQSSEAAQPPKMSSTAFSIAQQAVDALGRGYNVNFDLSLSYCKQGKRLIDIDESGPTQDLLLPGNIIIPNMPASIKCDKGDRTRFTTEVLKFNEMSEQFNQNLSILGKIPTGHFNTMFDFSGSWQKDASQVKTLAMDGFFINLYTVELPRAQLSLKEEVRAAVPSSWDPAALASFVKKYGTHVIVGVKIGGKDMVCLKQQRTSQLSTVRVQKILEEKAKERFTSIAGGTSKENNKGKDVRVMFKRKGGKAVSQSHEEWLHTVPAAPDIVSMSFVPITSLLNGVMGTGFLSHAINHFLRYKPSIAELHHFLEFQLPKEWAPAFGDLPLGPPRKQQASPSLQFRLMGPKLQVNTMPVVVGKSCVTGIRLHLEGKKSNRLAIHLQYLTAVPQILQGLWEDYQPESWEGPDTDFSKYFEPVMWRSFSHVCTAPVESKEPWVDEMKGEPALKGALVVTGAQLDVEQHGSKKVLFLRLLYSKIHKVRIRRSEWDHTPASQQRSGIFSTLISTHFSSAPSSPSKPVQVNSAIYPDGPPLANSQAPKLLKFVDTSAMTRGPLDLPGHWLVTGAKLDVERGKIAVRAKYSLLLYGAD

SEQ ID NO: 375 - protein, 477 aa, Tupidanthus calyptratus
MAFNANRFDPQSAAEKAVSAIGSGYDLTVDIRLSECKPGPSGSGLIELDRTLTKDLNLPCGRVVRNVSPSIKCGKGEQTRFHSDVLTFVQMSEQFNQDISLSGKIPSGLFNAMFDFKGCWQKDAATTKSLAFDGWFFSMYNIELARSQITLSEQVKKEVPSSWDPAALAEFIEKYGTHIVVGVKMGGKDVIHLKQLQNSNLQPTEVQKLLKQLADERFSEDVNGSLIPNPEKSSGKQKEEPSIVQDLNLPFANLLRQAVVSQSKNDDLLSIRIRRGGFDTGQSHKQWLSTVSQFPNAISMSFVPLASLLSGIRGSGFLSHAINLYLRYKPPMEELEQFLEFQVPRQWAPVYGDLPLAPRRKKQASPSLKFTFMGPRLYVNTIRVDSENRPVTGIRLYLEGKKSDHLAIHLQHLSTLPKILQLSEDLSYEPIDEPAEKGYLEAVKWSIFSHVCTQPVQYNGARIDDSASIVTKAWFEV

SEQ ID NO: 376 - protein, 615 aa, Symphoricarpos x chenaultii (Hancock)
MFEEAMEERGGKPIEIRAMEALGLGFDLASDFRLKFAKGGGRERMVVLDEANRRDILLPGGTAIRGVSQDIRCDKGDQIRFKSDVLEFNQMSELLNQKSSVQGKIPSGFFNAIFDLSGAWLSDAADAKYLAFDGYFISLYYLHLTASPLVLQDHVKKSVPSHWNPASLSRFIQTYGTHIIVGMGVGGQDLLCIKQRPSSAIPPADLRGYLEDLGDCLFSDGRSPSLLERKTRDGKQKVPEVFNRILQSHTMQFTSITETSSKDGLTLIWSKRGGDVFSHSHSKWLQTVSANPEAILFKFVPITSLLTGVPGSGYLSHAINLYLRYKPAAEDLQYFLEFQVPRQWAPLFCELPLRHQRRKPSCPLLQFSFMGPKIHVNSSQVSTGEKPVIGLRLYLEGKKCNRLAIHVQHLSSLPSMMTFESDKHLTISSQWRGSDSYDSHSQFLEPIKWKRYSNICSSVVKHDPSWLTAQSNGVFVVTGAQLISKGKWPKTVLHLRLLFSYLPNCTILKTEWASAPEASRKLGFLTNLSTTFTQRTVNDAPKQLPATLNSGVYPDGPPVAAQSVKLLKYVDTNEVVRGPHDSPGHWLVTAAKLVTEGGKIGMHVKFALLDYSQDL

SEQ ID NO: 377 - protein, 386 aa, Vernonia noveboracensis
MSFYQTNFYDPQSAAEKAVSVIGYGYDLTSDIRLTGCKPGPTGSTLIELDRTLSKDLVVPGGVVVHDVSPAIKCDKGERTRFHSDVLSFNHMSEQFNQEVSLSGKIPSGFFNSMFGYKGCWQKDAATTKNLAFDGWFITLYNIELEKAQIVLSEKVKQQVPSLWDPTALAEFIDKYGTHIVVGVKMGGKDVIYLKQLHSSNLEPTEVQNLLKQLADDEWSEDVSASSVSGPDKLIKQKDARSVAWDIPVLGNSIRQPIVISRSKKDDLLSIHVRQGGIDHGQSHKSWLSTVSQSPNVISMSFVPIVALLGGVRGSGFLSHAINLYLRYKPPIEELEQFLEFQLPRQWAPAYGDLPLAPRRKKTPSPSLQFTFLGPRLYVNTIKVKS

SEQ ID NO: 378 - protein, 580 aa, Asplenium australasicum
MASGKDAVVLAAVESLGCGFDLTSDYRLKYKKGPLLHLQHSNKKDLTIPGGITIPDVSRDIKCDKGERIRFTSEVMQFQQMSQWFNQNSSVEGKIPLGLFNAMFDLSGSWQDDASQIKNLAFDGFFITLYKLHLARSNLVLREEVKNDIPSVWDPKSLAKFIEKYGTHIIVSASVGGQDVLYLKENYSSPLSAQDVHKNLKSVGDDYFADRAQRSTNYKDSETLPLNALNSQTFRPTVAHINSAQVLHSCKDFTIISQRRGGYLFAKTHCGWQETVNMFPDAISLSFVPITSLLLGVAGSGFLQHAINLYLRYKPPVSDIQYFLDFQVPRQWIPVHNELPLRLTGRQPFSPSLQFSFMSPKLYVNNNEVVVDRKPLTGIRLYLEGRKSNRLAIHLQHLSVLPQSLGQLWSDSTKSEAHLWNSSADAPREWHEPVMWKCFSHVCTQPIKYKREWSTDHESVFIVTGARLEVKAHGLKSVLHLHLLFSKISGCTIQRSRWHQHQTAEKAGFFSTLSTTFSSTAKAGKKGPPAVVDSAVYIGGPPRPIESPKLLKYVDTAELTKGPQDAPGHWVVTAARLDLL

SEQ ID NO: 379 - protein, 641 aa, Asplenium prolongatum x Asplenium antiquum (Kurata)
MASADGRFAATQAQSSEAAQPQITSSTAFSIAQQAVDALGRGYDVNFDLRFGYCKQRKHLIENDELGPTQDLLLPGNIIIPNMPASIKCDKGERTRFTTEVLTFNEMSEQFNQDLSISGKIPTGHFNNMFDFSGSWQKDASQVKTLALDGFFINLYTVELPRAQLTLKEEVRAAVPSSWDPVALASFVEKYGTHVIVGVKIGGKDVICLRQHHSSQLSAVGVQKILEAKAKERFTYIVGGTSKEKINKGKIRDGFSYGSDVMNAVNGSKDGLSLSWMNDSLSDLLTVETADVKVMFKRKGGKDVSQSHEEWLHTVPAAPDIVSMSFVPITSLLNGVTGTGFLSHAINHYLRYKPPIDQFRHFLEFQLPKDWAPAFGDLPLGPPRKQQASPSLQFRLMGPKLQVNTTPVMVGKRCVTGVRLHLEGKKSNRLAIHLQYLTVVPQILQSRWEDDQLENWEGPDTDFSKYFEPVLWRSFSHVCTAPVESKEPWVDEMRGEPVLKGALVVTGAQLDVEQHGSKKVLFLRLLYSKIHKAASRRSEWEHTPASSQRSGIFSTLISTPFSSAASSPSKPVHVNSAIYPDGPPPANSQGPKLLKFVDTSEMTRGPLDLPGHWLVTGAKLSVERGKIAVRTKYSLLLYSED

SEQ ID NO: 380 - protein, 618 aa, Tupidanthus calyptratus
MEGGEETVKPIGLRAMESLGLGFDFASDFRLKFAKRCPGAGGDDRLVVLDEASRRDVVFPGGGVIRGVPECIRCDKGDRIRFKSDVLKFNQMSELVNQKSSVQGKVPSGYFNAMFDLSGSWLNDAADANHLAFDGYFISLYYLHLIASPLVLRDKVKNSVPSHWNPASLSRFILTYGTHIIVGLAVGGQDVICVKQRPSSGIPPAELRGYLEDLGDCMFSDGRNPVLERKTRDGKQKVPEVFNRMLQSHTMQFSSITETSSKDGLTILSSKRGGDVFSQNHSNWLQTVASNPEAICFKLVPITSLLTGVPGSGYLSHAINLYLRYKPAPEDLRYFLEFQVPVQWAPLFCELPLRHQRRKASCPLLQFAFLGPKIHVSSTQVTSGEKPVVGLRLFLEGKKCNRMAIHAQHLSSLPNIMEFALSNSATSRPCQWRGSDDYISNDQFLEPVRWKRYSNVCSSVVEHDSNWIQGEEVGAFVVTGAQLISKGKWPKTILHLRLLFSYLPNCTIRKTEWAAAPEASQKSGFRLNLSTTFTFSQRTGADAPKQLPAALNSGVYPEGPPVPLRSKKLLKYVDVAEVVRGPHDTPGHWLVTAAKLVTDGGKIGLHVKFALLDYLPGS

SEQ ID NO: 381 - protein, 639 aa, Asplenium nidus var plicatum
MASTVGGLAAMQAQSSEAAQPPNMSSTALSIAQQAVDALGRGYNVNSDLSLSYCKQGKRLIEIDESVPTQDLLLPGNIIIPNMPASIKCDKGDRTRFTTEVLTFNEMSEQFNQNLSISGKIPTGHFNTMFNFSGSWQKDASQVKTLAMDGFFINLYTVELSRTQLSLKEEVRAAVPSSWDPAALASFVKKYGTHVIVGVKIGGKDVVCLKQHHTSQLSTIRVQKILEEKAKERFTSIAGGTSKEKINKGKIRDGSPYGSNAMNGSKDGLSLSWMNDSLSDLLTVETDDVRVMFKRKGGKDFSQSHEEWLHTVPAAPDIVSMSFVPITSLLSGVIGTGFLSHAINHFLRYKPAIAELHHFLEFQLPKEWAPAFGDLPLGPPRKQQASPSLQFRLMGPKLQVNTMPVVVGKRCVTGIRLHLEGKKSNRLAIHLQYLTAVPQILQGLWEDHRPDNWEGPDTDFSRYFEPVMWRSFSHVCTAPVESKEPWVDEMKGEPVLKGVLVVTGAQLDVQQHGSKKVLFLRLLYSKIRKVRIRRSEWDHTPASQQRSGIFSTLISTTFSSAPSPPSNKPVQVNSAIYPDGPPLANGQAPKLLKFVDTSAMTRGPLDLPGHWLVTGAKLDVERGKIAVRAKYSLLLYGTD

SEQ ID NO: 382 - protein, 408 aa, Tupidanthus calyptratus
MYPNKLIVIKVSGYDLAHGLSFQQMSEQFNQEVSLSSKIPTGHFNAAFQFTGCWQKDAANTKTLALDGVFITIYTIALEKSQITLCDHIKEAVPSSWDPAALARFIEKFGTHVIVGVKMGGKDIVYMKQQHSSPLQSDEVQKRLKHVADNRFSNASGHSTNPEKVYEREMLEINEPPQEFMDDSASSSYMDLEDITFFYRRRGGSNKKNLPHDKWCQSVQLEPDVISMSFIPISSLLSGINGNGFLTHAINLYLRYKPAIEELSQFLEFQHPRQWAPVFGELAVGPERKQQSGASLQFSFLGPKLYVNTTLVDAGKRPVTGLRLYLEGTKSNCLAIHLQHLSTLPKSFQLQDEATCNYGSNDQRYYEKVQSKSFSHVCTGPVESDEDHSIVTGAQFEVRNSETTSTAI

SEQ ID NO: 383 - protein, 339 aa, Symphoricarpos x chenaultii (Hancock)
MAFNAANRFDPQSAAEKAVSVIGYGYDLTADIRLSACKAGPSGSRLIEIDQSATKDLVVPGGIVVPNVSASIKCDKGERTRFRSDVLSFNQMSEQFNQELSLSGKIPSGLFNAMFGFKGYWQKDAATTKTLAFDGWFISLYNIELARAQISLSESLKKEVPSSWDPAGLAEFIEKYGTHIIVGVKMGGKDVIHLKKLQDSNLESTEVQKLLKQLADERYAEDVSGSLDSNPDKSSGKLKDGQSVVWDLQLPFASSLRPSIVSHSKNESMLSIHIRRGGIDNCQSHNQWLSTVSRSPNVISMSFVPIASLLSGVRGSGFLSHAINLYLRCEYAYLYILPL

SEQ ID NO: 384 - protein, 614 aa, Symphoricarpos x chenaultii (Hancock)
MAFNAANRFDPQSAAEKAVSVIGYGYDLTADIRLSACKAGPSGSRLIEIDQSATKDLVVPGGIVVPNVSASIKCDKGERTRFRSDVLSFNQMSEQFNQELSLSGKIPSGLFNAMFGFKGYWQKDAATTKTLAFDGWFISLYNIELARAQISLSESLKKEVPSSWDPAGLAEFIEKYGTHIIVGVKMGGKDVIHLKKLQDSNLESTEVQKLLKQLADERYAEDVSGSLDSNPDKSSGKLKDGQSVVWDLQLPFASSLRPSIVSHSKNESMLSIHIRRGGIDNCQSHNQWLSTVSRSPNVISMSFVPIASLLSGVRGSGFLSHAINLYLRYKPPIEELQQFLEFQLPRQWAPAYGDLPLASRRKKQPSPALQFTFMGPKLYVNTVKVDSGNRPVTGVRLYLEGKKSDHLAIHLQHLSTLPEILQLSDDLSYEPIDEPVERGYFEPVKWSIFSHICTAPVQYNGARIDESASIVTKAWFEVKAVGMKKVLFLRLGFSMVASARIRRSEWDGPTSSSRKSGLISMLISTPFSTGLNQQQKKPEKVDLNSAVYPGGPPLPTRAPKMSHFVDTKEMVRGPEDPPGYWVVTGAKLCVEGGRIRIKVKYSLLTIISDDSLFM

SEQ ID NO: 385 - protein, 619 aa, Verbascum chaixii (Vill)
MAYYGHSNARLDAKAAAEKAVSVIGFGYDLTSDIRLSACKPGPSGSGLIELERSRTKDLVVPGNVVVSNVSGSIKCDKGERTRFSSDALTFNQMSEHFNQELSLSGKIPSGLFNTMFGFKGCWQNDASTSKILAFDGWLISLYTIELERSQITLSDKVKQEVPSTWDPPALAEFIEKYGTHVIVGVKMGGKDAIHIKQLKNSNLQPTEVQKLLKQLADEQFSEDGNEDPTADSDISSGKSKVQQSLIWDLQIPFTSTVRPPVVSHSKTDDLLSIHIRRGGLDSGQSHKKWLSTVSQYPNVISMSFVPIASLLSGTRGSGFLSHAINLYVRYKPPLEELTQFLEYQLPRQWAPAYNDLPLGHCRRKKASPSLQFSLLGPKLYVNTVKVDTGNRPVTGLRLYLEGKKSDHLAIHLQHLSTLPQSLQLSPDHTYDPGDDSIDRGYFEPVKWSIFSHICTAPVEYHGARIDDSASIVTKAWFEVKGVGMKKVLFLRLGFSMVASAIIRRSEWDGPTSTSKKSGLISMLMSTPFSTALNNNNNQTDKLNKINLNSAVYPGGPPSPAKAPKMSHFVDMKEMVRGPEEPPGYWVVTGAKLCVEMGMVRIKVKYSLLTIFSDDSLFM

SEQ ID NO: 386 - protein, 640 aa, Asplenium australasicum
MASAVGRFAATQAQSSEAAQPQITSSPAFSIAQQAVDALGRGYDVNFDLRLGYCKQRKHLIENDELGPTQDLLLPGNISIPNLPASIKCDKGDRTRFTTEILTFNEMSEQFNQDLSISGKIPTGHFNNMFDFSGSWQKDASQVKTLALDGFFINLYTVELPRAQLTLKEEVRAAVPSSWDPAALASFVEKYGTHVIVGVKIGGKDVICLRQHHSSQLSAVGVQKILEAKAKERFTSIAGGTSRENNKGKIRDGFTYGSNAMIAVNGSKDGVHPSWLNSSLSDLPPVETDDVKVMFKRKGGKAVSQSHEEWLHTVPSSPDIVSMSFVPITSLLNGVTGTGFLSHAINHYLRYKPPIDQLRHFLEFQLPKDWAPAFGDLPLGPPRKQQASPSLQFRLMGPKLQVNTMPVVVGKRCVTGIRLHLEGKKSNRLAIHLQYLTAVPQILQGLWEDHRPDNWEGPDTDFSRYFEPVMWRSFSHVCTAPVESKEPWVDEMKGEPVLKGALVVTGAQLDVQQHGSKKVLFLRLLYSKIRKVRIRRSEWDHTPASQQRSGIFSTLISTHFSSAPSPLSKPVQVNSAIYPDGPPLANSQAPKLLKFVDTSEMTRGPLDLPGHWLVTGAKLCVERGKIAVRAKYSLLLYSED

SEQ ID NO: 387 - protein, 636 aa, Platycerium wandae
MASAAGGFAALQPQSSEAAPPQSSPFSVAQLAIDALGRGYDVNSDLWLRNCPHNERLIEDNPGPTQDLLLPGNIVISNVSSSIKCDKGDRTRFTSDVLTFNEMSEQFNQNLALSGKIPVGHFNAMFGFSGSWQRDASAVKNLAMDGVFITLYSVELPRSQLTLKEEVKAAVPSSWDPAALASFLEKYGTHVIVGVKVGGKDVICLKQHRSSSLSAVGVQKILEAKGKERFSSVEGSTAKEKINKGKIRDGSLFGSNGLNALNGSKDLPWMSDSSTDFSTVETEDVTVIFKRKGGRDRSQSHDEWLLTVPLFPDVVSMSFVPITSLLSGITGTGFLNHAINHYLRYKPPIQELHHFLEFQLPKEWAPAFGDLPLGPPRKQAGSPSLQFRLMGPKLQVNTTPVVIGKRCVTGLRLHLEGKKSNRLAIHLQYLTVVPQILQQLWQDDQSEVWEGPDEDASKYFEPVMWKSFSHVCTAPVESTETWEDEGKGDPESKGAQVVTGAQLDVLQCGSKKVLFLKLLYSKIHKARVRRYEWDHVPASQQKSGIFSTLMSTTFSSVQASPQKPVQVVVNSAIYPQGPPAANSQAPKLLKFVDTSEMTRGPLDLPGHWLVTGAKLFVDRGKIAVRAKYSLLLYSVD

SEQ ID NO: 388 - protein, 598 aa, Verbascum chaixii (Vill)
MALKLPAAEAAKVAIHSIGCGYDISLDLRLKYCKGDSSLIEIDEDHGREIVLPGGVTIPNVPKSIKCDKGERTRFRSDVLTFQQMSEQLNQELALTGKIPSGLFNAMFEFSGCWQKDAAYTKTLSFDGMFITLYTVALEKSHMVLRDNVKKEVPSSWDPASLARFISKFGTHVIVGLKMGGKDVIYMKQQHSSSLQSADVQKRLKAMADKRFLDANGQSELNSEQLYQSGKLEMKESRLRFADTGSSSSYSHKDDIVSICKRRGGTDGRNLNHKEWLQTVQSEPDVISMSFIPITSLLNGVSGSGYLSHAINLYLRYKPPIEELHQFLEFQLPRQWAPVFSDLPLGPQRRQQSTASLQFSLLGPKLFVNTSAVDVGKRPVTGLRLYLEGRRSNRLAIHLQHLSSLPNIFQLEDDPNGNFRQESHDRRYYEKVQWKNFSHICTAPVESDEELSIVTGAQLQVGDYGFKKVLFLRLRFSTVLGAVSVKYPEWDGSPGLARKSGLISTLISHHFTAVQKPSPQPADVNINSAVYPGGPVPVQTSKLLKFVDTAEMTRGPQNSPGYWVVSGARLVVEKGRISIRVKYSLLTVVQPDDDDVSE

SEQ ID NO: 389 - protein, 520 aa, Nephrolepis exaltata (compacta)
MSQQFNQGLSLSGKIPSGLFNYMFNFTGSWQKDASTTRHLALDGWFYTLYTVEIPRSQLVLKEDIKASVPTSWEAAALARFIETFGTHIIVGAKIGGKDVVYMKQHQSSPSTSIDFQKLLAEVSDERFAQTEGRTSVGSKDGRINKKKRGIEIQSWAAHLDTFSQITYNEKHHVTIIPRRKGGFDHGQSHSDWIHTVPLAPDIISVSLIPITSLLHGVSGSGFLSHAVNLYLRYKPPIEELRQFLEFQFPREWAPVFSELPLTLSRREHSVSTLQFTLMGPKLKVSKLQVTVGKKPVTGMRLFLEGKRCDKLAIHLQHLSAIPRFLQPLWEDHPFAREVTWQDPDDCSTKYFEPVQWKNFSHVCTAPVENMETWIGDHAGACVVIGAQLAVKSFGLKNVLYLRLLYSKIPEAKIRRSEWDHMPASTQKSGMFSSFLSSTFSSAPAPAKVPAVVINSGIYSEGPPKPVRDPKLLKFVDTTEMTKGPQDMPGHWLVTGAKLYLDKGKISLRVKYSLLTVSSD

SEQ ID NO: 390 - protein, 578 aa, Matteuccia struthiopteris
MARSYVAYVITPRDPFCNTTPTGTSLFPEASQFRMFREMSNVTKESASALPLSSYSFNRCLNGSIKMLLLKERFLLGFSMLCLICLDLGKMMQTNYRISPLMYTLSLYKLHLTRSHLVLREEVKNDIPSVWDPQSLAKFIEKYGTHIIVSASVGGQDVLYLKENYSSLLSTQDIHKKLKSAGDDYFSDRGGEKSANFKESETLPLNALSSQPFRATVAHIHSAQVLVTNKDFTIISQRRGGYHFAKTHCGWQETVNIFPEAISLSFVPITSLLVGVAGSGFLQHAINLYLRYKPPVSDIQYFLDFQVPRQWIPIHNELPLRLARKQTFSPSLQFSLTGPKLYINNNEVVVNRKPVTGIRLYLEGRKSNRLAIHLQHLSVLPQSLGQFWNEGTELESPWWNGSNDAPKEWFEPVEWKCFSHVCTQPIKYKPEWLNERGSAFVVTGARLEVKAHGLKNVLHLHLLFSKIPGCTIQRSRWGQHPAAEKTGFFSSISTTFSSTTKAGKKGPPVVVDSAVFIGGPPRPIQSPKLLKFVDTTELTKGPQDAPGHWVVTAARLELDRGKISVSVKFSLLNYADAE

SEQ ID NO: 391 - protein, 429 aa, Symphoricarpos x chenaultii (Hancock)
MGGKDVIHLKKLQDSNLESTEVQKLLKQLADERYAEDVSGSLDSNPDKSSGKLKDGQSVVWDLQLPFASSLRPSIVSHSKNESMLSIHIRRGGIDNCQSHNQWLSTVSRSPNVISMSFVPIASLLSGVRGSGFLSHAINLYLRYKPPIEELQQFLEFQLPRQWAPAYGDLPLASRRKKQPSPALQFTFMGPKLYVNTVKVDSGNRPVTGVRLYLEGKKSDHLAIHLQHLSTLPEILQLSDDLSYEPIDEPVERGYFEPVKWSIFSHICTAPVQYNGARIDESASIVTKAWFEVKAVGMKKVLFLRLGFSMVASARIRRSEWDGPTSSSRKSGLISMLISTPFSTGLNQQQKKPEKVDLNSAVYPGGPPLPTRAPKMSHFVDTKEMVRGPEDPPGYWVVTGAKLCVEGGRIRIKVKYSLLTIISDDSLFM

SEQ ID NO: 392 - protein, 527 aa, Waldsteinia ternata
MFLQMSELLNQKSSVQGKIPSGYLNSIFGLSGDWLQDAAETKYLAFDGFFISLYNLHLTASPLVLRNKVQKSVPSRWDPAALSRFIHSYGTHIIVGMAVGGQDLVCVRQKSSSPVPPADLRRNLEDLGDFLFSDGPSLLRGKTRNGKQKIPEVFDRILQSNTMQLTTISETSSKDGLTVVCSKRGGDVFLNSHSNWLQTVLAEPEAIIFKFVPITSLLTGLPGSGYLSHAINLYLRYKPDLEDLQHFLEFQVPRQWAPMFCELPLSHQRKKASCPSLQFSFMGPKILVSSMQVSTSQKPVVGLRLYLEGKKCNRLAVHVQHLSSLPNTMELKLANTRTTRPSWWRGSDDSEFSGQFLEPIKWKRYSSICSSVVRYDPNWLKGDPGGVYIVTGAQLLSKGKWPKTILHLRLHYTFLPSCAIRKTEWAGSPEPSHKSTFLMNLSTTFTMTQRTVTDQQKQDPAALNSGVYPEGPPVLNRSAKLLKFVDTAEVVRGPHDAPGHWLVIAAKLVKEGNRIGLHTKFALLDYW

SEQ ID NO: 393 - protein, 387 aa, Aglaomorpha (Roberts)
MASKLDIPNAATVAHLAIQSLGRGYDLTCDLRFSSFKDVNGASLIELRDSETIELSLPGGVVVANVPAIVKCDKGERTRFRSDILAFEQMSQQFNQGLSLSGKIPCGLFNNMFNFTGSWQKNSSNTKHLALDGWFYTLYNMEMPRSQLVLKEDIKASVPSSWEPVALARFIETFGTHIVVGVKVGGKDVVYMKQHQSSPSTSIEFQKLLAEVSDERFLRSEGRASVGSKDSRSNKKHNIEFQPWSAHLDTFSQMSYNEKHHVTIIPRRKGGFDHGQSHSEWIHTVPLAPDIISVSLIPITFLLHGVAGSGFLSHASNLYLRYKPPIEELRQFLEFQLPREWAPVYSELPLTLPRREPSLSTLQFTFMGPKLKVSKLEIAFNLAQERA

SEQ ID NO: 394 - protein, 613 aa, Tupidanthus calyptratus
MEGGEETVKPIGLRAMESLGLGFDFASDFRLKFAKRCPGAGGDDRLVVLDEASRRDVVFPGGGVIRGVPECIRCDKGDRIRFKSDVLKFNQMSELVNQKSSVQGKVPSGYFNAMFDLSGSWLNDAADANHLAFDGYFITLYCLHLTASPLVLRDKVKKSVPSHWNPASLSRFIQTYGTHVIVGLAVGGRDLICVKQRQSSGIPPAELRGYLEDLGDCLFSDGKSPLLERKARDGKQNVPEVFTRMLQSNTKHFTSITETSSKDGLTIILSKRGGDVFSQSHSKWLQTVASNPEAISFKLVPITSLLTGVRGSGYLSHAINLYLRYKPIPEDLQYFLEFQVPRQWAPLFCEMPLGHQRRKASCPPLQFSFMGPKTRISSTLVTSGQKPVVGLRLFLEGKKCNHLAIHVQHLSSLPNIMAFACANSTISKPSQWRGSDDYESSDQFLEPVRWKRYSNVCSSVVKHDPNWIQGEEPGGAFIVTGAQLISKGKWPKTVLHLYLLFTYLPNCTIRKTEWAAAPETSRRSGFLTNLSTTFTFTQRDVADAPKQLPAALNSAIYPDGPPVPLSSGKLLKYVDVSEVVRGPHDTPGHWLVTAAKLVTDGGKIGLHVKFALL

SEQ ID NO: 395 - protein, 388 aa, Symphoricarpos x chenaultii (Hancock)
MAFNAANRFDPQSAAEKAVSVIGYGYDLTADIRLSACKAGPSGSRLIEIDQSATKDLVVPGGIVVPNVSASIKCDKGERTRFRSDVLSFNQMSEQFNQELSLSGKIPSGLFNAMFGFKGYWQKDAATTKTLAFDGWFISLYNIELARAQISLSESLKKEVPSSWDPAGLAEFIEKYGTHIIVGVKMGGKDVIHLKKLQDSNLESTEVQKLLKQLADERYAEDVSGSLDSNPDKSSGKLKDGQSVVWDLQLPFASSLRPSIVSHSKNESMLSIHIRRGGIDNCQSHNQWLSTVSRSPNVISMSFVPIASLLSGVRGSGFLSHAINLYLRYKPPIEELQQFLEFQLPRQWAPAYGDLPLASRRKKQPSPALQFTFMGPKLYVNTVKVNSL

SEQ ID NO: 396 - protein, 318 aa, Platycerium hillii
MILPSSIPALSWQVQKAAALAAVEALGCGFDLTSDYRLKYKKGPLLELQHSHNKDLTIPGCITIPDVSRGIKCDKGEHMRFTSEVMQFQQMSQWFNQNASVEGKIPLGLFNAMFDLSGSWQDDANRLKNLAFDGCFITLYKLHLPRSNLVLREEVKNDIPSVWDPKSLAKFIEKYGTHIIVSASVGGQDVLYLKENYSSLISAQEIRKKLKSAGDEYFSETSGKRNADFKHSETSPLNSQPFRGTIAGSAQLLISNKDYTLISQRRGGYYFAKTHCEWQETVNMYPEAISLSFIPITSLLLIGCGWKRLFAACDQSLS

SEQ ID NO: 397 - protein, 519 aa, Vernonia noveboracensis
MSEQFNQEISLTGKIPSGLFNAMFEYSGSWQKDASSTKTLAFDGVFISLYTVALEKSQMVLCDNVKKAVPSSWDPALLARFIEKFGTHIIVGVKMGGKDVIYMKQQHASSLQPADVQKRLKAMADKRFLDADGQYIIDAEHTSHNDKDDIRGQRLRFADADPSSSYSYKEDLVSIYKRRGGCDDRNLKHNEWLHGVQLEPDVITMSFIPITSLLNGVSGSGYLSHAINLYLRYKPPVEELHQFLEFQLPRQWAPVFSDLPLGPQRKQQTTPSLQFSFFGPKLYVNINPVDVGKRPVTGLRLYLEGKRSNRLAIHLQHLSSLPKVFQLEDDVDGNLAEESYDRRYYEKVQWKHFSHVCTAPVESDDELSIVTGAHLHVGDYGFKRILFLRLRFSTVVGAAAIKNPEWDGSPGLARKSGLISTLISHHFTAVLKSQPQAAEVNINSAIYPGGPPAPVQVPKLLKFVDTAEMTRGPQESPGYWVVSGGRLVVDKGKISVRVKYSLLTVVSADDEEAAAALDV

SEQ ID NO: 398 - protein, 616 aa, Stenochiaena tenuifolia
MASVDGGFVAMQAQSSKGMPKNTAFQVAQHAVDSLGRGYDVNADLWLRYCKRSERLIENDDSGPKQDLLLPGNIIIPNVPSSIKCDKGDRMRFTSDVLTFSEMSEQFNQTLSISGKIPVGHFNSMFGFSGSWQKDASQVKTLAMDGVIINLYSVELPREQLTLKEEVRAAVPSSWDPAALASFVEKYGTHVIVGIKIGGKDMICLKQHRSSSLPAVGVQKILEAKAKERFSSVESSAIKEKVNKGKDGMPLSWMNDSAPEIETDDVTVIFKRKGGRDISLSHEDWLHTVPSAPDIVSMSFIPITSLLNGVAGTGFLSHAINHYLRYKPPIQELRYFLEFQLPKEWAPAFGDLPLGPPRKQQDSPSLQFRLMGPKLQVNTTPVFIGKRCVTGLRLHLEGKKSNRLAVHLQYLTVVPQILQRLWEDDQPEEWVGPDDDFSKYFEPVMWKSFSHVCTAPVESNETWVDESRGENALKGALVVTGAQLNVEQHGSKKVLFLRLLYSKIHKATVRRSEWDHTPASQQKSGIFSTLLSTPFSSQAAPVKPVQVVVNSAIYPDGPPAAKSQAPKLLKFVDTTEMTRGPLDLPGHWLVTGAKLFVDRGKIAVRAKYSLLLYSED

SEQ ID NO: 399 - protein, 509 aa, Equisetum
MDQTRAKESIQALGCGYDVLDDLRLNRYKGDSKYRLIELDESQTQDLVIQGGITIPGVPKAITCEKGERTRFRTDVLPFQQMSEQVNQWMSIPGKIPLGLFNGMFGLSGHWQKDALSVKNLAIDGWLITFYSVELPKSQLVLREEVKKEVPSSWDPQGLASFIEKYGTHIIIGVKIGGKDVLCMKQHQSSSLSTIEIQALLKKKADERFANTEYGDDALSTEQKFDGEKNSAMNQSNQFQLYTATTVLYSSQDNATILCSRRGGNDVGQSHNQWLQTVPGSPDVVLMSFVPITSLLNGVAGSGFLSHAINLYLRHKPPIEELMHFLEFQLPRQWAPAFSDLPLGPPKKGQSTSLLRFSLIGPRLYVNTTPVSVGRRPVTGLRLYLEGRRCNRLAIHVQHVSSVPRVLQPFWEDHPFAGEPKWQGPEDPDERYSEPVFWRSFSHVCTAPVENADVWGGDSASGAHVVVGARLVVKKWGALRNVLYLDLLYSKIPQAKIRRPEWNHTPATL

SEQ ID NO: 400 - protein, 396 aa, Tupidanthus calyptratus
MEGGEETVKPIGLRAMESLGLGFDFASDFRLKFAKRCPGAGGDDRLVVLDEASRRDVVFPGGGVIRGVPECIRCDKGDRIRFKSDVLKFNQMSELVNQKSSVQGKVPSGYFNAMFDLSGSWLNDAADANHLAFDGYFISLYYLHLIASPLVLRDKVKNSVPSHWNPASLSRFILTYGTHIIVGLAVGGQDVICVKQRPSSGIPPAELRGYLEDLGDCMFSDGRNPVLERKTRDGKQKVPEVFNRMLQSHTMQFSSITETSSKDGLTILSSKRGGDVFSQNHSNWLQTVASNPEAICFKLVPITSLLTGVPGSGYLSHAINLYLRYKPAPEDLRYFLEFQVPVQWAPLFCELPLRHQRRKASCPLLQFAFLGPKIHVSSTQVIYLSTQTDMRMHRSL

SEQ ID NO: 401 - protein, 619 aa, Verbascum chaixii (Vill)
MAYYGHSNARLDAKAAAEKAVSVIGFGYDLTSDIRLSACKPGPSGSGLIELERSRTKDLVVPGNVVVSNVSGSIKCDKGERTRFSSDALTFNQMSEHFNQELSLSGKIPSGLFNTMFGFKGCWQNDASTSKILAFDGWLISLYTIELERSQITLSDKVKQEVPSTWDPPALAEFIEKYGTHVIVGVKMGGKDAIHIKQLKNSNLQPTEVQKLLKQLADEQFSEDGNEDPTADSDISSGKSKVQQSLIWDLQIPFTSTVRPPVVSHSKTDDLLSIHIRRGGLDSGQSHKKWLSTVSQYPNVISMSFVPIASLLSGTRGSGFLSHAINLYVRYKPPLEELTQFLEYQLPRQWAPAYNDLPLGHCRRKKASPSLQFSLLGPKLYVNTVKVDTGNRPVTGLRLYLEGKKSDHLAIHLQHLSTLPQSLHLSPDHNYEPCDDSIDRAYFEPVKWSIFSHICTAPVEYHGARFDDSASIVTKAWFEVKGVGIKKVLFLRLGFSNVSSAIIRRSEWAGPTSTSKKSGLISMLMSTPFSTALNNNNNQTDKLNKINLNSAVYPGGPPSPAKAPKMSHFVDMKEMVRGPEEPPGYWVVTGAKLCVEMGMIRIKVKYSLLTIVSDESLLM

SEQ ID NO: 402 - protein, 266 aa, Phormium (Lancer Terra Cotta)
MEGEGEPVEIMALKALGLGFDLTNDFRLRFAKGWYPYRRLVELDEGNTRDIVIPGNLTIRDVPVDVGCDKGDRIRFRSDVLEFNQMSELLNQKSSIQGKVPSGYFNALFDLSGAWLDDAKNTKHLAFDGYFISLYNLHLRSSPLVLRDEVKKAVPSKWEPVLLSRFIRTYGTHIIVEMAVGGQDVICVKQSHSSTISTAELKLHLEDLGDILFSDGRNLSPLHRKGREGRNKVPDIFFKILQSNNLQLASYSETSSKDVRPANLVF

SEQ ID NO: 403 - protein, 599 aa, Tupidanthus calyptratus
MGSSKEIGLKLKATAEAAIQSIGFGYDITEDLRLKYCKGSRLIVIDDDQVRDIVIPGGILVPNVSKQINCDKGERIRFSSDGLSFQQMSEQFNQEVSLSSKIPTGHFNAAFQFTGCWQKDAANTKTLALDGVFITIYTIALEKSQITLCDHIKEAVPSSWDPAALARFIEKFGTHVIVGVKMGGKDIVYMKQQHSSPLQSDEVQKRLKHVADNRFSNASGHSTNPEKVYEREMLEINEPPQEFMDDSASSSYMDLEDITFFYRRRGGSNKKNLPHDKWCQSVQLEPDVISMSFIPISSLLSGINGNGFLTHAINLYLRYKPAIEELSQFLEFQHPRQWAPVFGELAVGPERKQQSGASLQFSFLGPKLYVNTTLVDAGKRPVTGLRLYLEGTKSNCLAIHLQHLSTLPKSFQLQDEATCNYGSNDQRYYEKVQSKSFSHVCTGPVESDEDHSIVTGAQFEVRNSGMKRVLFLRLHFSKVIGSTVFKQPEWDGSPIIAQKSGIISTLISSRFSANQKQPPRPSDFNINSAIYPSGPPVPAQATKLLRFVDTSEMTRGPQDRPGYWIVSGARLLVDRGKISLCVKYSLLAVILPEDEMSLQ

SEQ ID NO: 404 - protein, 601 aa, Phormium (Lancer Terra Cotta)
MALKFPPRKAAEFAINSIGLGYDVAADIRLKYCKRETQDPCLIELDKDQLQDIVLPGGITVSNVPKSIKCDKGERTRFRSDVLSFQQMSEQFNQELSLSGKIPSGLFNYMFEFSNCWQKDAANTKSLAFDGWFITLYTVALAKSQIVLRDHVKQAVPSSWDPAALARFIEKFGTHVIVGVKMGGKDVIYVKQQHFSNLQPAEVQKILKDMADKRFLDVSGQYGMNSEEAFGKDKFDFKEQRLRFADSSSSSSYSTKEDIVRIFKRRGGNDNKDLPHPEWLNTVQYEPDVISMSFVPITSLLQGIPGSGFLSHAINLYLRYKPPTEELHQFLEFQLPRQWAPVFSDLPLGPQRKHQSTASLQFTFMGPKLYVNTSVVDVGKRPVTGLRLYLEGKRSNRLAIHLQHLSSLPRIFELHDDPSSSYSRESHDRKYYEPIQWRHFSHVCTAPIEADEDNSIVTGAQLHVGHYGLKKVLFLRLHFSTVSNVSLVRNFEWDGSPGLTHKSGLISTLISTRFTAAIQKPPPRPADVYINSAVYPGGPPVPVQTPKLLKFIDTTEMVRGPQDPPGYWVVSGAKLQLERGKISLRVKYSLLTVMLPEEEDV

SEQ ID NO: 405 - protein, 657 aa, Pteris cretica (roweri)
MHPQSSEVATSQPHSRAFLVAQQAVDALGRGYDVTCDLWLSYCKNGELLIENDESSPTQDLFLPGNIAIPRISTAVKCDKGDSSPTQDLFLPGNIAIPRVSTAVKCDKGDRTRFTTDVLTFNEMSEQFNQSLAISGKIPLGHFNGMFNLSGSWQRDASMVKTMAMDGVYINLYSVELSRTKLALKEEVKAAVPSSWDPAALASFVEKYGTHVIVGVKIGGKDVICIKQRSSSSLSAVGVQRILEAKSKERFSSIEGSMSKEKTDRGKIRDGSILGSNGINAAHKSGVPLPWIHDSSSDFSVETDEVTVTFKRKGGRDSSQSHDEWLQTVPSAPDIVSMSFVPITSLLNGITGTGFLSHAINLYLRYKPTIQELHHFLEFQLPKEWAPAYGDLPLGPPRKQQGSPSLQFRPLGPKLQVNTTPVVVGKRCVTGIRLHLEGKKGNRLAVHLQYLTVVPQILQRTWEDDQPEIWEGPDTDFLKYFEPVMWKSFSHVCTAPVESSEMWDDETKGEQGGPRAALVVTGARLDVEQHGSKKVLFLRLLYSKIHGASIRRSEWDDAPASQQKSGIFSTLMSTTFSTAQASPLKPVQVVVNSAIYQGPPPANSQAPKLLKFVDTTEMTRGPVDSPGHWLVTGAKLFVGNGKIAVRPKYSLLLYSME

SEQ ID NO: 406 - protein, 355 aa, Hedera helix (Galaxy)
MKLKQKSFKYQVLDHLIMSQTTSNAVKATELDINQIFSTSTRCRNSSTKNAQFRGKFRQDCSTQCLVSRSDIGSWAKEAANTKYLGLDGYFILLFDLHINRYPLVLSDEVRNAVPSTWDPSALARFIEKYGTHIIVGLGIGGQDVVLLRQDKSSNVEASQLKKNLDQLGDQLFTGSCTFTPKDQKQKALPVFNVFDQQSLLSDNFSSVKTKNGIHVICSKRGGDVSANTHCEWLLTVPSMPDAIQFSFIPITSLLKGVPGNGFLSHAINLYLRYKPPLADLQYFLDFQVHKIWAPVHSELTLGPATIRPTRMAALHFNLIGPKLYVNTSQVTVGRRPVTGIRLYLEGMKCNRYSQ

SEQ ID NO: 407 - protein, 571 aa, Sphaeropteris cooperi
MASARESGRAVARAAVEALGCGFDLTADYRLKYRKGPLLNLQHSRKDLLIPGGITIPNVSRDVKCDKGERTRFTSEVMKFQQMSQWFNKNAFVEGKIPLGFFNAMFDLSGSWQHDASLTKSLAFDGCFITLYKLHLTRSNLVLREEVKKDIPSTWDPEGLARFIEKYGTHIIVAVNIGGQDVLYLKESHSSLLSTQDIHKHLKIAGDKCFSDGSGERSIDFKENEDVTIISQRRGGIVSSKTHSKWQETVDSSPDAISFSFVPITSLISGVSGSGFVQHAINIYLRYKPPVENIRYFLDFQVPRQWIPVYNELPLGLSRKQALSQSLQFSLMGPKLHVNTLQVVVIKKPVTGVRLYLEGRKSNRLAIHLQHLSVLPQCLEQFWNENIPVEQPKWNGSNGAAKNWFEPVYWKSFSHVCTTPVKYKPEWLDDKDSVFVVTGARLEVKVHGLKSVLHLQLLFTKILGCKIQTSRWDQPPAPEKSSFFSTFSTTFSTTTKAGKKGTPVVVDSAVYPGGPPRPIQSPTLLKFVDTTESTKGPHDVPGHWIVTAARLELDRGKISLRVKYSLLNYSL

SEQ ID NO: 408 - protein, 490 aa, Tupidanthus calyptratus
MALKVSAPEAAKIAIQSIGCGYDISLDLRLKCCKGDPANPRLIEIHEDQGREIVLPGGIVIPNVSKAIKCDKGEHARFRSDVLSFQQMSEQFNQEMSLTGKIPSGVFNTMFEFTGSWQKDAANTKTLAFDGVFITLYTVALEKTQMILSDHVKQAVPSSWDPAALARFIEKFGTHIIVGVKMGGKDVIYMKQQHSSSLQPSDVQKRLKTIADKRFVDASGQYGMDSEQTHQNDKFQIREQRLRFADTSPSSSYSYKEDIVIICKRRGGSDNKNLTHNEWLHNVQLEPDVISMSFIPITSLLNGVSGSGFLSHAINLYLRYKPPVEELHQFLEFQLPRQWAPVFSDLPLGPQRRQQSTSSLQFSLMGPKLYVNTTPVDVGKRPVTGLRLYLEGKRSNRLAMHMQHLSSLPKIFQLEDDPNGNFHQESYDRRYSWQCTCSTFPLFRKSSNLKMIQMGTSAKSHMIIDTTRKFSGRTSPTSALLRSNPMKIYP

SEQ ID NO: 409 - protein, 598 aa, Polystichum polyblepharum (Roeme x Kunze)
MASGKDAAALAAVEALGCGFDLTSDYRLKYRKGPLLHLQHSCNKDLTIPGGITIPDVSRDVKCDKGERMRFASEVMQFQQMSQLFNQNASVEGKIPLGLFNAMFDLSGSWQDDANQIKNLAFDGFFITLYKLHLTRSNLVLREEVKKDIPSVWDPQSLAKFIEKYGTHIIVSASVGGQDVLYLKENYYSLLSAQDIHKKLKSAGDDYFSDSSGKRNTNFKDCETLPLNALNSQPYRATGAHTHSSQLLITTKDFTIISQRRGGFHFAKTHCEWQETVNIVPEAISLSFVPITSLLLGVAGSGFLQHAINLYLRYKPPVSDLQYFLDFQVPRQWIPIHNELPLRLARKQVFSPSLQFSLMSPKLYISNNEVVVTKKPVTGIRLYLEGRKSNRLAIHLQHLSVLPQSLGQFWSGSTQMESPRWNDSNDAPKDWFEPVEWKCFSHVCTQPIKYKPEWLNERDSAFVVTGARLDVKVHGLKSVLHLHLLFSKIPGCTIQRSRWYQHPAAEKTSFFSSISTTFSSTTKAGKKGPPVLVDSAVFIGGPPRPIQSPKLLKFVDTTELTKGPQDSPGHWVVTAARLELDRGKISLGVKFSLLNYTE

SEQ ID NO: 410 - protein, 618 aa, Tupidanthus calyptratus
MEEEGGKPIEVIAMESLGLGFDFASDFKLKFAKRCPDGAGDDGRLVVIDEANKRDVVFPGGGVIRGVPESIRCGKGDRIRFKSDVLKFNQMSELINQKSSVQGKVPSGYFNAMFDLSGSWFNDAADSNHLAFDGYFISLYYLHLIASPLVLRDKVKNSVPSHWNPASLSRFILTYGTHVIVGLAVGGRDLICVKQRQSSGIPPAELRGYLEDLGDCLFSDGKSPLLERKARDGKQNVPEVFTRMLQSNTKHFTSITETSSKDGLTIILSKRGGDVFSQNHSNWLQTVASNPEAICFKLVPITSLLTGVPGSGYLSHAINLYLRYKPIPEDLQYFLEFQVPRQWAPLFCEMPLGHTERKASCPLLQFAFLGPKIHVSSTQVTSGEKPVVGLRLFLEGKKCNHLAIHVQHLSSLPNIMAFACANSTISKPSQWRGSDDYKSSDQFLEPVRWKRYSNVCSSVVKHDPNWIQGEEPGGAFIVTGAQLISKGKWPKTVLHLYLLFTYLPNCTIRKTEWAAAPETSRRSGFLTNLSTTFTFSQHQQRRAPKQLPAALNSAIYPDGPPVPLSSGKLLKYVDVSEVVRGPHDTPGHWLVTAAKLVTDGGKIGLHVKFALLDYLPEP

SEQ ID NO: 411 - protein, 605 aa, Phormium (Lancer Terra Cotta)
MALKFPPRKAAEFAINSIGLGYDVAADIRLKYCKRETQDPCLIELDKDQLQDIVLPGGITVSNVPKSIKCDKGERTRFRSDVLSFQQMSEQFNQELSLSGKIPSGLFNYMFEFSNCWQKDAANTKSLAFDGWFITLYTVALAKSQIVLRDHVKQAVPSSWDPAALARFIEKFGTHVIVGVKMGGKDVIYVKQQHFSNLQPAEVQKILKDMADKRFLDVSGQYGMNSEEAFGKDKFDFKEQRLRFADSSSSSSYSTKEDIVRIFKRRGGNDNKDLPHPEWLNTVQYEPDVISMSFVPITSLLQGIPGSGFLSHAINLYLRYKPPTEELHQFLEFQLPRQWAPVFSDLPLGPQRKHQSTASLQFTFMGPKLYVNTSVVDVGKRPVTGLRLYLEGKRSNRLAIHLQHLSSLPRIFELHDDPSSSYSRESHDRKYYEPIQWRHFSHVCTAPIEADEDNSIVTGAQLHVGHYGLKKVLFLRLHFSTVSNVSLVRNFEWDGSPGLTHKSGLISTLISTRFTAAIQKPPPRPADVYINSAVYPGGPPVPVQTPKLLKFIDTTEMVRGPQNPPGYWVVSGAKLQLERGKISLRVKYSLLTVLLPDDDDDDDDV

SEQ ID NO: 412 - protein, 644 aa, Asplenium australasicum
MASAVGRFAATQAQSSEAAQPQITSSPAFSIAQQAVDALGRGYDVNFDLRLGYCKQRKHLIENDELGPTQDLLLPGNISIPNLPASIKCDKGDRTRFTTEILTFNEMSEQFNQDLSISGKIPTGHFNNMFDFSGSWQKDASQVKTLALDGFFINLYTVELPRAQLTLKEEVRAAVPSSWDPAALASFVEKYGTHVIVGVKIGGKDVICLRQHHSSQLSAVGVQKILEAKAKERFTSIAGGTSRENNKGKIRDGFTYGSNAMIAVNGSKDGVHPSWLNSSLSDLPPVETDDVKVMFKRKGGKAVSQSHEEWLHTVPSSPDIVSMSFVPITSLLNGVTGTGFLSHAINHYLRYKPPIDQLRHFLEFQLPKDWAPAFGDLPLGPPRKQQASPSLQFRLMGPKLQVNTTPVVVGKRCVTGIRLHLEGKKSNRLAIHLQFLTVVPQILQSRWEDDQLEDWEGPDTDFSKYFEPVMWRSFSHVCTAPVESREPWAADEMAGEAALKGALVVTGAQLDVEQHGSKKVLFLRLLYSKIHKAMNRRSEWDHTPASSQRSGIFSTLISTPFSSAAASSPAAAKPVHVNSAIYPDGPPPANSQAPKLLKFVDTSEMTRGPLDLPGHWLVTGAKLCVERGKIAVRAKYSLLLYGAD

SEQ ID NO: 413 - protein, 331 aa, Platycerium bifurcatum
MASAKEAAALAAVEALGCGFDLTSDYRLKYKKGSLLELQHSHNKDLTIPGCITIPDVSRGIKCDKGEHMRFTSEVMQFQQMSQWFNQNASVEGKIPLGLFNAMFDLSGSWQDDANRLKNLAFDGCFITLYKLHLTRSNLVLREEVKNDIPSVWDPKSLAKFIEKYGTHIIVSASVGGQDVLYLKENYSSLISAQEIRKKLKSAGDEYFSETSGKRNADFKHSETSPLNSQPFRGTIAAGDEYFSETSGKRNADFKHSETSPLNSQPFRGTIAGSAQLLISNKDYTLISQRRGGYYFAKTHCEWQRTTSHFQQGLYSDFSKARRILFCEDPL

SEQ ID NO: 414 - protein, 597 aa, Tupidanthus calyptratus
MALKLPAPEAAKIAIQSIGCGYDICLDLRLKYRKRDSTNLSLIEIHEDQEKEIVLPGGILIPNVSKAIKCDKGEHARFRSDVLSFQQMSEQFNQEMSLTGKIPSGVFNTMFEFTGSWQKDAAHTKTLAFDGLFITLYTVALDKSQMVLSDHVKKAVPSSWDPAALARFIEKFGTHIIVGVKMGGKDVIYMKQQHSSSLQPSDVQKRLKTIADKRFVDASGQYGMDSEQTHQNDKFQIREQRLRFADTSPSSSYSYKEDIVIICKRRGGSDNKNLTHNEWLHNVQLEPDVISMSFIPITSLLNGVSGSGFLSHAINLYLRYKPPVEELHQFLEFQLPRQWAPVFSDLPLGPQRRQQSTSSLQFSLMGPKLYVNTTPVDVGKRPVTGLRLYLEGKRSNRLAMHMQHLSSLPKVFQLKDDPNGNFRQESYDRRYYEKVQWKNFSHICTAPVESDEDLSIVTGAQLEVGDYGFKRVLFLRLRFSTVLGAVAVKHPEWDGSPGLARKSGLISTLISHHFTATLKPPPQPADVNINSAVYPGDPPGPAQAPKLLKFVDTTEMTRGPQDSPGYWVVSGARLMVEKGRISLRVKYSLLAAILPDE

SEQ ID NO: 415 - protein, 466 aa, Asplenium antiquum (makino)
MCPLLSNATRVNRPTSGQTFSLLIRFIETFGTHIIIGAKIGGKDVVYLKQHQVSTSTLADFQKLLAEVSEERFSQTEGRASVGSKDSHSNNKRSMQFKSWTAPLDSFSQIIYNDKHHVTIIPRRKGGFDHGQSHSDWVHTVPLAPDVISVSLVPITSLLNGVPGSGFLSHAVNLYLRYKPPTEELRQFLEFQLPREWAPVFSELPLTLCRREQSPSTLQFTLMGPKLKVNKSQVTIGRRPVTGMRLFLEGKRCDRLSIHLQHLSAMPNFLTSFWEDHPFAREATWQDPDDYSTKYFEPLQWKNFSHICTAPVENTETWIGDHAGASVVVGAQLAVKSYKLRNVLYLRLLYSKIPEAKIRRSEWDHVPALAQKSGMFSSFFSTTFSSTAVTGAAKAPAVVINSGVYPEGPPKPVQDPKLLKFVDTTEMTKGPQDMPGHWLVTGAKLYLDRRKISLRVKYSLLTVSLD

SEQ ID NO: 416 - protein, 535 aa, Tupidanthus calyptratus
MEGGEETVKPIGLRAMESLGLGFDFASDFRLKFAKRCPGAGGDDRLVVLDEASRRDVVFPGGGVIRGVPECIRCDKGDRIRFKSDVLKFNQMSELVNQKSSVQGKVPSGYFNAMFDLSGSWFNDAADSNHLAFDGYFISLYYLHLIASPLVLRDKVKNSVPSHWNPASLSRFILTYGTHIIVGLAVGGQDVICVKQRPSSGIPPAELRGYLEDLGDCMFSDGRNPVLERKTRDGKQKVPEVFNRMLQSHTMQFSSITETSSKDGLTILSSKRGGDVFSQNHSNWLQTVASNPEAICFKLVPITSLLTGVPGSGYLSHAINLYLRYKPAPEDLRYFLEFQVPVQWAPLFCELPLRHQRRKASCPLLQFAFLGPKIHVSSTQVTSGEKPVVGLRLFLEGKKCNRMAIHAQHLSSLPNIMEFALSNSATSRPCQWRGSDDYISNDQFLEPVRWKRYSNVCSSVVEHDSNWIQGEEVGAFVVTGAQLISKGKWPKTILHLRLLFSYLPNCTIRKTEWAAAPEASLVEEIFKCMLISSRA

SEQ ID NO: 417 - protein, 398 aa, Vernonia noveboracensis
MADKRFLDSDGQYVIDAEHICHNDKDNIRGQRLRFADSDPSSSYSYKEDLVSIYKRRGGSDDRNLKHNEWLHSVQLEPDVISMSFIPITSLLNGVSGSGYLSHAINLYLRYKPPVEELHQFLEFQLPRQWAPVFSDLPLGPQRKQQSSPSLQFSFFGPKLYVNINPVDVGKRPVTGLRLYLEGKRSNRLAIHLQHLSSLPKVFQLEDDVDGNLAEESYDRRYYEKVQWKNFSHVCTAPVESENELSIVTGARLHVGDYGFKKVLFLRLRFSTVVGAAAIKNPEWDGSPGLARKSGLISTLMSHHLTAVLKPQSQAAAEVNINSAIYPGGPPSPVQTPKLLKFVDTAEMTRGPQESPGYWVVSGGRLVVDKGKISVRVKYSLLTVVSADDEEAAAALDV

SEQ ID NO: 418 - protein, 595 aa, Nephrolepis cordifolia (Duffii)
MASTKEAAALAAVKALGCGFDLTSDYRLKYKKGPLLHLQHSYTKDLTIPGGITIPDVVRDVKCDKGERIRFASEIMQFQQMSQFFNQNSSIEGKIPLGLFNAMFDLSGSWQDDANRIKNLAFDGCFITLYKLHLTRSNLVLQEEVKNDIPSVWDPQRLAKFIEKYGTHIIVSASIGGQDVLYLKENSSSLLSAQDLHKKLKSAGEEYFSDKGAKGNTSFKDSETSPLNALHSHQFRALAPSAQLFISNKDYTIISQRRGGYFFAKNHCEWQETVNSYPEAISLSFVPITSLLLGIAGSGFLQHAINLYLRYKPPVSDLQYFLDFQVPRQWIPIHNELPLRLARKQVFSPSLQFSLTSPKLYVNNNEVVVNRKPVTGVRLYLEGRKSNKLAIHLQHLSVLPQSLGQFWSESTQMELPRWNGSNDAPNDWFEPVEWKCFSHVCTQPIKYKPEWLNERGGAFVVTGARLDVKAHGLKSILHLHLLFSKIPGCTIQRSRWNEHPAAEKAGFFSSISTTFSATTKTGKKGPPVVVDSAIFMEGPPRPIQSPKLLKFVDTTELTKGPQDAPGHWVITAARLELEKSKISLRAKFSLLNYTE

SEQ ID NO: 419 - protein, 540 aa, Tupidanthus calyptratus
MAFNANRFDPQSAAEKAVSAIGSGYDLTVDIRLSECKPGPSGSGLIELDRTLTKDLNLPCGRVVRNVSPSIKCGKGEQTRFHSDVLTFVQMSEQFNQDISLSGKIPSGLFNAMFDFKGCWQKDAATTKSLAFDGWFFSMYNIELARSQITLSEQVKKEVPSSWDPAALAEFIEKYGTHIVVGVKMGGKDVIHLKQLQNSNLQPTEVQKLLKQLADERFSEDVNGSLIPNPEKSSGKQKEEPSIVQDLNLPFANLLRQAVVSQSKNDDLLSIRIRRGGFDTGQSHKQWLSTVSQFPNAISMSFVPLASLLSGIRGSGFLSHAINLYLRYKPPMEELEQFLEFQVPRQWAPVYGDLPLAPRRKKQASPSLKFTFMGPRLYVNTIRVDSENRPVTGIRLYLEGKKSDHLAIHLQHLSTPPKRLQLSDDLSYEPIDEPAEKGYLEAVKWSMFSHICTQPVQYNGARIDDSASIVTKAWFEVKGIGMKKVLFLRLGFSTVASAVIRRSEWDGPTMSTRKSGLMSMLISTRFSTGLTEKPELRKPI

SEQ ID NO: 420 - protein, 291 aa, Platycerium hillii
MSEQFNQNLALSGKIPVGHFNAMFGFSGSWQKDASAVKNLAMDGVFITLYSVELPRSQLILKEEVKAAVPSSWDPAALASFLEKYGTHIIVGVKIGGKDVICLKQHRSSSLSAVGVQKILEAKGKERFSSVEGSTSKEKINKGKIRDGSSFGSNGMNALNGSKDLPWMSDSSTDYSTVETEDVTVIFKRKGGRDRSQSHDEWLHTVPLFPDVVSMSFVPITSLLNGITGTGFLNHAINHYLRYKAPIQELHHFLEFQLPKEWAPAYGDLPLGPPRKQAGSPSLQFKPLTTV

SEQ ID NO: 421 - protein, 607 aa, Phormium (Lancer Terra Cotta)
MRPTDLMTPEAAAAAAVSAVGYGYDLVGDLRLSSCKAGPSGSRLIKIDDALVHDLVLPGGVVVPNVPKEIRCDKGERTRFRSDVLGFHQMAEQFNQDLSLSGKIPSGLFNAMFDFRGCWQKDLSSTKSLAFDGWFITLYSIELAKSHIVLQDKIKQEIPSSWDPVALAEFIEKYGTHIIVGIKMGGKDAVSIKQLQESALQQTEVQNLLKNLADDAFSEDFNANILLGAAEISKRLKGIKLANQENNAAVLKSMNSSIVTHLKKDDIVSIHVRRGGINTKQSHNQWLSTISQAPNVISMSFVPITSLLTGVRGSGFLSHAVNLYLRYKPPIEELHHFLEFQLPRQWAPVFNEIPLGPQHRKRRRLPSLQFTLMGPRLHVNTDKVDSKNRPVTGIRLFLEGKRNDCLAIHLQHLSTRPNIFQLSNDSDHTSADDISLNQRDYYEPIKWALLSHICTAPVQYSGASIDDSASIVTKAWLEVKDIGMRKVLFLRLGFSNVVGMKIRRSEWDGLTNVTRKSGSISAMISSRFSTGMIPPQKPKVEINSAVFPGGPPVPIRVPKMSRFVDTTEMMRGPDDLPGYWLVTGAKLCVEGGGISLKVKYSLLIRRR

SEQ ID NO: 422 - protein, 457 aa, Tupidanthus calyptratus
MYPNKLIVIKVSGYDLALTVSLSSRFIEKFGTHVIVGVKMGGKDIVYMKQQHSSPLQSDEVQKRLKHVADNRFSNASGHSTNPEKVYEREMLEINEPPQEFMDDSASSSYMDLEDITFFYRRRGGSNKKNLPHDKWCQSVQLEPDVISMSFIPISSLLSGINGNGFLTHAINLYLRYKPAIEELSQFLEFQHPRQWAPVFGELAVGPERKQQSGASLQFSFLGPKLYVNTTLVDAGKRPVTGLRLYLEGTKSNCLAIHLQHLSTLPKSFQLQDEATCNYGSNDQRYYEKVQSKSFSHVCTGPVESDEDHSIVTGAQFEVRNSGMKRVLFLRLHFSKVIGSTVFKQPEWDGSPIIAQKSGIISTLISSRFSANQKQPPRPSDFNINSAIYPSGPPVPAQATKLLRFVDTSEMTRGPQDRPGYWIVSGARLLVDRGKISLCVKYSLLAVILPEDEMSLQ

SEQ ID NO: 423 - protein, 604 aa, Pteris cretica (roweri)
MSSMAIARETARSSALAVVESLGCGFDLTSDYRLKYRKGPLLELQHNSTKDLTIPGGITIPDVSRDIKWDKGERTRFASEVMQFQQMSQWFNQNASVEGKVPLGLFNAMFDLSGSWQDDASQIKNLAFDGCFITLYKLHLTRSNLVLREDVKNDIPSVWDPQGLARFIEKYGTHLIVSANVGGQDVLYLKENQASLLPSQDLHKQLKAAADDYFSDKVGERNQNFKDSETFPLNGLKDQSSAAVIAHLHSPQLLISNKDFTIISQRRGGHYACKTHLEWQETVNVFPEAISLSFVPITSLLLGVAGSGFLQHAINLYLRYKPPVGDIQYFLDFQVPRQWIPSHNELPLRLARKQAFSPSLQFRFIGPKLYINNNEVVVDRKPVTGLRLFLEGRMSNRLAIHLQHLSVLPQSLGQFWSENANKEPPCWNGSTEAPKEWFEPVEWKCFSHVCTQPVKYKPEWLDVKGSAFVVTGARLEVKAHGFQSILHLNLLFSKIPGCVIQRSRWDQPPASEKTGFFSSLSTTFTSTARPVKKGPAINIDSAVFVGGPPRPIQSPKLLKYIDTTELTRGPQDAPGHWVVTAAHLELDRSKISLRVKFSLLSYMD

SEQ ID NO: 424 - protein, 597 aa, Tupidanthus calyptratus
MALKVSAPEAAKIAIQSIGCGYDISLDLRLKCCKGDPANPRLIEIHEDQGREIVLPGGIVIPNVSKAIKCDKGEHARFRSDVLSFQQMSEQFNQEMSLTGKIPSGVFNTMFEFTGSWQKDAANTKTLAFDGVFITLYTVALEKTQMILSDHVKQAVPSSWDPAALARFIEKFGTHIIVGVKMGGKDVIYMKQQHSSSLQPSDVQKRLKTIADKRFVDASGQYGMDSEQTHQNDKFQIREQRLRFADTSPSSSYSYKEDIVIICKRRGGSDNKNLTHNEWLHNVQLEPDVISMSFIPITSLLNGVSGSGFLSHAINLYLRYKPPVEELHQFLEFQLPRQWAPVFSDLPLGPQRRQQSTSSLQFSLMGPKLYVNTTPVDVGKRPVTGLRLYLEGKRSNRLAMHMQHLSSLPKVFQLKDDPNGNFRQESYDHRYYEKVQWKNFSHICTAPVESDEDLSIVTGAQFGVGDYGFKRVLFLRLRFSTVRGGLAVKNPEWDGSPGLARKSGLISTLISHHFTATLKPPPQPADVNINSAVYPGDPPGPAQAPKLLKFVDTTEMTRGPQDSPGYWVVSGARLMVEKGRISLRVKYSLLAAILPDE

SEQ ID NO: 425 - protein, 668 aa, Lygodium japonicum
MFYTSSSSSAPSDPASVAKQAVDALGRGYDVTGDLWLSKCREPLIVDLAESSPTQDLAIPGGISLPCVPAPIKCDKGDRTRFASDILSFSEMSEQFNKTLSIAGKIPLGLFNSMFGFTGLWQKDASSTKTLGLDGVFINLYSVEVPRTHLTLREEVRKAVPSSWDPAALASFVEKYGTHVIVGVKIGGKDVVYIKQRHSSTLSGVSIQKILETKALERFSSGETCTSKEKLTKGKHSSTLSAVSIQKILETKALERFSSGETCTSKEKLTKGKDFQTKGIHGAEPNGQNGNLLRGHVDGIENSESFSLMEDSSTFSVDGDVTVIYKRKGGRESCQSHNDWLHTVPLAPDVVSMSFVPITTLLNGVPGTGFLSHAINLYLRYKPPLQELSNFLEFQLPKEWAPAFGDLPLGPPRKQQEVPSLQFRLMGPKLHINTTPVVVGKRPVTGLRLYLEGKKSNRLAIHLQYLTAVPQILKTLWVEDGGGEEEWVGPEEDFSKYLEPVQWRNFSHVCTAPVENSETWLGGPGGALVVVGARLQVQQYGAKKVLFLHLLYSRIAKARIRRSEWDHMPASQQKSGLFSTLISTTFSSAAAQSPAPPKPVVINSAIYPEGPPVPGQMPKLLKFVDTTEMTRGPHDLPGHWLVTGAKLLLERGKISLRAKYSLLLYSVE

SEQ ID NO: 426 - protein, 593 aa, Davallia fejeensis
MAYGKDAAALAAVEALGCGFDLTSDYRLKYKKGSLLQLQHSHNKDLTIPGGISIPDVSRDIKCDKGERMRFASEVMPFQQMSQWFNQNASIEGKIPLGLFNAMFDLSGSWQDDANRIKNLAFNGSFITLYKLHLPMSNLVLREEVKKDVPSVWDPKNLARFIEKYGTHIIVSASVGGQDVLYLKENSSSSLSAQDIHKKLKSAGDEYFSDNGGKSNADFKGSENLPLHSQPIRGTIAHSAQLLISNKDYTVMSQRRGGYFLAKTHCEWQETVNMYPEAISLSFVPITSLLLGAAGSGFLQHAINLYLRYKPPVSDLQYFLDFQVPRQWIPVHNELPLRLARKQAFSPSLQFSLMSPKLYINNTEVVVNRKPVTGIRLYLEGRKNNRLGIHLQHLSVLPQSLCQIWSEASQVESPQWNGSNDAPNDWFEPVEWKCFSHVCTQPIKYKPEWQNERGSAFVVTGARLDVKAHGLRSVLHLHLLFSKIPGCTIQRSRWDQHPASEKMGFFSSISTTFSSTIKAGKKGPPVVVDSAVFMGGPPRPIQSPKLLKFVDTAELTKGPQDAPGHWVVTAARLELDRGKIAIKVKFSLLNYTE

SEQ ID NO: 427 - protein, 610 aa, Asplenium australasicum
MASKHDIPNAARVANLAFQSLGRGFDLTCDLRFSSCKDVHGAPLIELSDKDLRKVSLPGGVIVPNVPTIVKCDKGEQTHFRSDILTFDQMSQEFNHGLSLSGKVPSGFFNYMFNFTGSWQKDASATRHLALDGWFYTLYTLEMPRSQLVLKEDIKAAIPTSWEPAALARFIETFGTHIIIGAKIGGKDVVYLKQHQVSTSTLADFQKLLAEVSEERFSQTEGRASVGSKDSHSNNKRSMQFKSWTAPLDSFSQIIYNDKHHVTIIPRRKGGFDHGQSHSDWVHTVPLAPDVISVSLVPITSLLNGVPGSGFLSHAVNLYLRYKPPTEELRQFLEFQLPREWAPVFSELPLTLCRREQSPSTLQFTLMGPKLKVNKSQVTIGRRPVTGMRLFLEGKRCDRLSIHLQHLSAMPNFLTSFWEDHPFAREATWQDPDDYSTKYFEPLQWKNFSHICTAPVENTETWIGDHAGASVVVGAQLAVKSYKLRNVLYLRLLYSKIPEAKIRRSEWDHVPALAQKSGMFSSFFSTTFSSTAVTGAAKAPAVVINSGVYPEGPPKPVQDPKLLKFVDTTEMTKGPQDMPGHWLVTGAKLYLDRRKISLRVKYSLLTVSLD

SEQ ID NO: 428 - protein, 642 aa, Asplenium australasicum
MASTVGGLAAMQAQSSEAAQPPNMSFTAFSIAQQAVDALGRGYNVNLDLSLSYCKQGKRLIEIDESGPTQDLLLPGNIIIPNMPASIKCDKGDRTRFTTEVLKFNEMSEQFNQNLSISGKIPTGHFNTMFNFSGSWQKDASQVKTLALDGFFINLYTVELPRAQLTLKEEVRAAVPTSWDPAALASFVKKYGTHVIVGVKIGGKDVVCLKQHHTSQLSTIRVQKILEEKAKERFTPIAGGTSKEKINKGKIRDGSPYGSNAMNGSKDGLSLSWMNDSLSDLLTVETDDVRVMFKRKGGKDVSQSHEEWLHTVPSSPDIVSMSFVPITSLLNGVTGTGFLSHAINHYLRYKPPIDQLRHFLEFQLPKDWAPAFGDLPLGPPRKQQASPSLQFRLMGPKLQVNTTPVVVGKRCVTGIRLHLEGKKSNRLAIHLQFLTVVPQILQSRWEDDQLEDWEGPDTDFSKYFEPVMWRSFSHVCTAPVESREPWAADEMAGEAALKGALVVTGAQLDVEQHGSKKVLFLRLLYSKIHKAMNRRSEWDHTPASSQRSGIFSTLISTPFSSAAASSPAAAKPVHVNSAIYPDGPPPANSQAPKLLKFVDTSEMTRGPLDLPGHWLVTGAKLCVERGKIAVRAKYSLLLYSED

SEQ ID NO: 429 - protein, 333 aa, Vernonia noveboracensis
MDYSEKPMELRAFDSLGLGFDFASDFRLKFAKACPGGGRLVVLDESRKRDIVLPGGGATISGVSEDIHCDKGDHVRFKSDVLEFNQMSELLNQKASVQGKVPSGYFNALFDLSGTWLNDVADAKRLAFDGYFISLYYLHLTASPLVLQDRVKKSVPTHWNPALLARFIQTYGTHIIVGMGVGGQDVICVKQKPSSTISPAELRGHLEDLGDSHFSDGTSPSLLERKSKDGKKKVPEVFNRMLQPHTMQFTNITETSSKDGLTIIGSKRGGDVFSDSHSKWLQTVGASPEAILFKFVPITSLLNGVPGSGYLSHAINLYLRCQCFKFNQKPSFS

SEQ ID NO: 430 - protein, 597 aa, Hedera helix (Galaxy)
MSNSSDHGIVGRALSSLGKGFDLTSDFRLKYCKGKDRLVLLNETQTKELQVPGFGSFNHVSNDIKCGKGDRTRYQSDILDFNQMSEFINQKCSVPGKIPSGLFNSMFGFEIGSWAKEAANTKYLGLDGYFILLFDLHINRYPLVLSDEVRNAVPSTWDPSALARFIEKYGTHIIVGLGIGGQDVVLLRQDKSSNVEASQLKKNLDQLGDQLFTGSCTFTPKDQKQKALPVFNVFDQQSLLSDNFSSVKTKNGIHVICSKRGGDVSANTHCEWLLTVPSMPDAIQFSFIPITSLLKGVPGNGFLSHAINLYLRYKPPLADLQYFLDFQVHKIWAPVHSELTLGPATIRPTRMAALHFNLIGPKLYVNTSQVTVGRRPVTGIRLYLEGMKCNRLAIHLQHLSNTPQFLHNKIDDTLLLWRGSEEFSNHGYFEPIQWKKFSHISTAPVKYDPKWSSEKDVTFIVTGAQIYVKKHDSISALHLRLLYSKVSGSCIVQSNWMQCQSDHSQKSGLLSALSSSILFGGSSEKEELKKVVVDSGVYPNGPPVPVQTQKLLKFVDMSELCRGPSDSPGHWLVTGAKLQLEKGKICLHVKFSLLNTF

SEQ ID NO: 431 - protein, 357 aa, Tupidanthus calyptratus
MEEEGGKPIEVIAMESLGLGFDFASDFKLKFAKRCPDGAGDDGRLVVIDEANKRDVVFPGGGVIRGVPESIRCGKGDRIRFKSDVLKFNQMSELINQKSSVQGKVPSGYFNAMFDLSGSWFNDAADSNHLAFDGYFITLYCLHLTASPLVLRDKVKKSVPSHWNPASLSRFILTYGTHIIVGLAVGGQDVICVKQRPSSGIPPAELRGYLEDLGDCMFSDGRNPVLERKTRDGKQKVPEVFNRMLQSHTMQFSSITETSSKDGLTILSSKRGGDVFSQNHSNWLQTVASNPEAICFKLVPITSLLTGVPDKPAPEDLRYFLEFQVPVQWAPLFCELPLRHQRRKASCPLLQFAFLGP

SEQ ID NO: 432 - protein, 299 aa, Tupidanthus calyptratus
MSEQFNQEMSLTGKIPSGVFNTMFEFTGSWQKDAAHTKTLAFDGLFITLYTVALDKSQMVLSDHVKKAVPSSWDPAALARFIEKFGTHIIVGVKMGGKDVIYMKQQHSSSLQPSDVQKRLKTIADKRFVDARGQSGMDSEQTYQKDKFQVREQRLRFADTSLSSSYSYKEDIVSICMRRGGNDNKNLTHNEWLHNVQLEPDVISMSFIPITSLLNGVSGSGFLSHAINLYLRYKPPTEELHQFLAFQLPLHWAPVFSVHPLGLQPRQQSTASLQFSFMGPKLHVNTSPVDVGKRPVTGL

SEQ ID NO: 433 - protein, 611 aa, Adiantum trapeziforme var braziliense
MASKHEDSNAAKVARLAIETLGRGYDLTCDLRFSSCKDADGASLIEINDKETHELTLPGGVVIGNVPTIVKNDKGERTHFRSEILTFDQMSQQFNQGLSLSGKIPCGLFNHMFNFSGIWQKDASTTRHLALDGWFYTLYTLEIPRSQLVLKEDIKALVPASWEPAALARFIENFGTHIIVGAKIGGKDVIYMKQHQSSPSTSVEFQKLLAEVSDERFLQSEGRSTSVGSMDNSSHKKRNIEFQSWSAQLDTFSQIVYNDKHHVTIIPRRKGGIDHGESHSEWIHTVPLAPDIISVILVPVTFLLSGVAGSGFLSHAVNLYLRYKPPVEELRQFLEFQLPREWAPVFGDLPLTLSRKDRSPSTLQFTLLGPKLKVSKMQVTVGKKPVTGMRLYLEGKKCDNIAIHLQHLSAIPRFLQPLWEDHPFAGEATWQDPDDYSTKYFEPVQWKNFSHVCTAPVENTETWIGDHAGAAVVVGAQLAVKNFGLKNVLYLRLLYSRIPEARIRRSEWDHMPATTQKSGMFSTLFSTTFSSTAAPAPAKASPVVLNSGIYPEGPPKPVQDPKLLKFVDTTEMTKGPQDMPGHWLVTGAKLYLDKKRISMRVKYSLLSISSD

SEQ ID NO: 434 - protein, 598 aa, Rumohra adiantiformis
MASGKDAAALAAVEALGCGFDLTSDYRLKYRKGPLLHLQHSYTKDLTIPGGITIPDVSRDVKCDKGERIRFASEVMQFQQMSQLFNQNASVEGKIPLGFFNAMFDLSGSWQDDANQIKSLAFDGCFITLYKLHLTRSNLVLQEEVKKDIPSAWDPQSLAKFIEKYGTHIIVSASVGGQDALYLKENYSSLLSVQDIHKKLKSVGDDYFSDIGGKRNSNLKDSETLPLNALSSQPFRGKVAHTHSTQLLITEKDFTIISQRRGGFHFAKTHCEWQETVNIVPEAISLSFVPITSLLLGVAGSGFLQHAINLYLRYKPPVSDLQYFLDFQVPRQWIPIHNELPLRLARKQASSPSLQFSLTSPKLYINNNEVVVNRKPVTGIRLFLEGRKSNRLAIHLQHLSVLPQSLGQFWSETSQMESPRWNGSNDAPKDWLEPVEWKCFSHVCTQPIKYKPEWLNERGSAFVVTGARLDVKVQGLKSVLHLHLLFSKIPGCTIQRSRWDQHLAEEKTSFFSSISTTFSSTAKAGKKGPPVVVDSAVFIGGPPRPIQSPKLLKFVDTTELTKGPQDAPGHWVVTAAQLELDRGKISVRVKFSLLNYAE

SEQ ID NO: 435 - protein, 396 aa, Tupidanthus calyptratus
MEGGEETVKPIGLRAMESLGLGFDFASDFRLKFAKRCPGAGGDDRLVVLDEASRRDVVFPGGGVIRGVPECIRCDKGDRIRFKSDVLKFNQMSELVNQKSSVQGKVPSGYFNAMFDLSGSWLNDAADANHLAFDGYFITLYCLHLTASPLVLRDKVKKSVPSHWNPASLSRFILTYGTHIIVGLAVGGQDVICVKQRPSSGIPPAELRGYLEDLGDCMFSDGRNPVLERKTRDGKQKVPEVFNRMLQSHTMQFSSITETSSKDGLTILSSKRGGDVFSQNHSNWLQTVASNPEAICFKLVPITSLLTGVPGSGYLSHAINLYLRYKPAPEDLRYFLEFQVPVQWAPLFCELPLRHQRRKASCPLLQFAFLGPKIHVSSTQVIYLSTQTDMRMHRSL

SEQ ID NO: 436 - protein, 670 aa, Asplenium australasicum
MASTVGGLAAMQAQSSEAAQPPNMSFTAFSIAQQAVDALGRGYNVNLDLSLSYCKQGKRLIEIDESGPTQDLLLPGNIIIPNMPASIKCDKGDRTRFTTEVLKFNEMSEQFNQNLSISGKIPTGHFNTMFNFSGSWQKDASQVKTLALDGFFINLYTVELPRAQLTLKEEVRAAVPTSWDPAALASFVKKYGTHVIVGVKIGGKDVVCLKQHHTSQLSTIRVQKILEEKAKERFTPIAGGTSKEKINKGKIRDGSPYGSNAMNGSKDGLSLSWMNDSLSDLLTVETDDVRVMFKRKGGKDVSQSHEEWLHTVPAAPDIVSMSFVPITSLLSGVMGTGFLSHAINHFLRYKPSIAELHHFLEFQLPKEWAPANHYLRYKPPIDQLRHFLEFQLPKDWAPAFGDLPLGPPRKQQASPSLQFRLMGPKLQVNTTPVVVGKRCVTGIRLHLEGKKSNRLAIHLQFLTVVPQILQSRWEDDQLEDWEGPDTDFSKYFEPVMWRSFSHVCTAPVESREPWAADEMAGEAALKGALVVTGAQLDVEQHGSKKVLFLRLLYSKIHKAMNRRSEWDHTPASSQRSGIFSTLISTPFSSAAASSPAAAKPVHVNSAIYPDGPPPANSQAPKLLKFVDTSEMTRGPLDLPGHWLVTGAKLCVERGKIAVRAKYSLLLYSED

SEQ ID NO: 437 - protein, 347 aa, Asplenium prolongatum x Asplenium antiquum (Kurata)
MFKRKGGKDVSQSHEEWLHTVPAAPDIVSMSFVPITSLLNGVMGTGFLSHAINHFLRYKPSIAELRHFLEFQLPKEWAPAFGDLPLGPPRKQQASPSLQFRLMGPKLQVNTMPVVVGKRCVTGIRLHLEGKKSNRLAIHLQYLTAVPQILQGLWEDYQPEKWEGPDTDFSRYFEPVLWRSFSHVCTAPVESKEPWVDEMRGEPVLKGALVVTGAQLDVEQHGSKKVLFLRLLYSKIRKVRIRRSEWDHMPASQQRSGIFSTLISTHFSSAPSSPSKPVQVNSAIYPDGPPPANSQAPKLLKFVDTSAMTRGPLDLPGHWLVTGAKLDVERGKIAVRAKYSLLLYSAD

SEQ ID NO: 438 - protein, 593 aa, Platycerium bifurcatum
MASAKEAAALAAVEALGCGFDLTSDYRLKYKKGSLLELQHSHNKDLTIPGCITIPDVSRGIKCDKGEHMRFTSEVMQFQQMSQWFNQNASVEGKIPLGLFNAMFDLSGSWQDDANRLKNLAFDGCFITLYKLHLTRSNLVLREEVKNDIPSVWDPKSLAKFIEKYGTHIIVSASVGGQDVLYLKENYSSLISAQEIRKKLKSAGDEYFSETSGKRNADFKHSETSPLNSQPFRGTIAGSAQLLISNKDYTLISQRRGGYYFAKTHCEWQETVNMYPEAISLSFIPITSLLLGAVGSGFLQHAINLYLRYKPPVSDLQYFLDFQVPRQWIPVHNELPLRLARKQAFSPSLQFSLMSPKLYIDNNEVVVSRKPVTGIRLYLEGRKNNRLAIHLQHLSVLPQSLGKFWSEGIQIEAPLWNGSSDAPNEWFEPVEWKCFSHVCTQPIKYKPEWSNEQGSAFVVTGAQLGVKAHGLKSVLHLHLLFSKIPGCSIQRSRWDQHPAAEKTGFFSSISTTFSTTTKAGKKGPPVVVDSAVYMGGPPRPIQSPKLLKFVDTAELTKGPQDAPGHWVVTAARLELDRGKIAIKVKFSLLNYAE

SEQ ID NO: 439 - protein, 650 aa, Lygodium flexuosum
MKPAAVTLRPNFYTSSSSSAPSDPASVAKQAVDALGRGYDVTGDLWLSKCREPLIVDLAESSPTQDLAIPGGISLPSVPAPIKCDKGDRTRFASDILSFSEMSEQFNKTLSIAGKIPLGLFNSMFGFTGLWQKDASSTKTLALDGVFINLYSVEVPRTHLNLREEVRKAVPSSWDPAALASFVDKYGTHVIVGVKIGGKDVIYVKQRHSSPLSAVSIQKILETKAVERFSSGETCTSKEKLTKGKDFQTKGIHGAEPNGQNGNLLRGHVDGMENSESFSLMEDSSTFSIDGDVTVIYKRKGGSESCQSHNDWLHTVPLAPDVVSMSFVPITTLLNGVPGTGFLSHAINLYLRYKPPLQELSNFLEFQLPKEWAPAFGDLPLGPPRKQQEVPSLQFRLMGPKLHINTTPVVVGKRPVTGLRLYLEGKKSNKLAIHLQYLTAVPQILKTLWVEDGGGEEEWVGPEEDFSKYFEPVQWRNFSHVCTAPVENSETWLGGPGGALVVVGARLQVQQYGAKKVLFLHLLYSRIAKARIRRSEWDHMPASQQKSGLFSTLISTTFSSAAAQSPAPPKPVVINSAIYPEGPPVPGQMPKLLKFVDTTEMTRGPHDLPGHWLVTGAKLLLERGGRSTCSWSDAQTLEVCGHYRDDKRAT

SEQ ID NO: 440 - protein, 617 aa, Waldsteinia ternata
MRMEEATTEKPIEVRALEALGQGFDLSSDFRLKFAKGLDGSKGRLVVLNEESKRDIVIPSGSGGGVVIHGVPQDIHCDKGDRIRFKSDVLEFNQMSELLNQKSSVQGKIPSGYLNSIFGLSGDWLQDAAETKYLAFDGFFISLYNLHLTASPLVLRNKVQKSVPSRWDPAALSRFIHSYGTHIIVGMAVGGQDLVCVRQKSSSPVPPADLRRNLEDLGDFLFSDGPSLLRGKTRNGKQKIPEVFDRILQSNTMQLTTISETSSKDGLTVVCSKRGGDVFLNSHSNWLQTVLAEPEAIIFKFVPITSLLTGLPGSGYLSHAINLYLRYKPDLEDLQHFLEFQVPRQWAPMFCELPLSHQRKKASCPSLQFSFMGPKILVSSMQVSTSQKPVVGLRLYLEGKKCNRLAVHVQHLSSLPNTMELKLANTRTTRPSWWRGSDDSEFSGQFLEPIKWKRYSSICSSVVRYDPNWLKGDPGGVYIVTGAQLLSKGKWPKTILHLRLHYTFLPSCAIRKTEWAGSPEPSHKSTFLMNLSTTFTMTQRTVTDQQKQDPAALNSGVYPEGPPVLNRSAKLLKFVDTAEVVRGPHDAPGHWLVIAAKLVKEGNRIGLHTKFALLDYW

SEQ ID NO: 441 - protein, 376 aa, Sphaeropteris cooperi
MGSEAAARKVALDAVQSLGRGFDVTADFRTKFCKKRLVHIVNDGLESLTLPGDITIDAPSVIKCDKGECTRHTSDLMQFQQMSQAFNKRALIDGKIPLGHFNAMYDFTGSWFEDAMQTKNLAFDGKFITLFQLQLTSSLLLRKEVKNAVPSAWEPAALARFISLYGTHIVVRVSVGGQDVLYLKENASSMMSSADVHKHLKNLGDQMFAEKGVQKIQDGNSLRGCSIAPVEIDGTNILYKSKDLTIIAKKRGGRLCAKTPSEWQATVMSAPDVIMMSFVPITALLSGTPGSGFLNHAINLYLRYKPPIEDIRCFLEFQVPRQWAPVYSDLPLGPPQRAITLPSLQFCLMGPRLYVNTAQVGRKNHFNWCLFGEVRL

SEQ ID NO: 442 - protein, 594 aa, Colysis wrightii (Ching)
MASAKDATALAAVEALGCGFDLTSDYRLKYKKGPLLQLQHSHNKDLTIPGGITIPDVSRDIKCDKGERMRFASEVMHFQQMSQWFNQNASVEGKIPLGLFNAMFDLSGSWQDDANRLKNLAFDGCFITLYKLHLTRSNLVLREEVKNDIPSVWDPKSLAKFIEKYGTHIIVSASVGGQDVLYLKENYSSLLSAQDIRKKLKSAGDEYFSEISGKKNADFKDSETLPLNSQPFRGTIAASAQLLISNKDYTVISQRRGGYYFAKTHWEWLETVNVYPEAISLSFVPITSLLSGAAGSGFLQHAINLYLRYKPPVSDLQYFLDFQVPRQWIPVHNELPLRLARKQAFSPSLQFSFMSPKLYINNNEVVVNRKPVTGIRLYLEGRKNNRLAIHLQHLSVLPQSLSQFWSEDIQIGLPQWNGSNDAPSDWFEPVEWRCFSHVCTQPIKYKPEWSNDRGSAFVVTGARLDVKAYGLKSVLHLHLLFSKVPGCSIQRSRWDQHLAEEKTGFFSSISTTFSTTTTKAGKKGPPVVVDSAVFMGGPPRPIQSPKLLKFVDTAELTKGPQDVPGHWVVTGARLELDRGKIAIKVKFSLLNYAE

SEQ ID NO: 443 - protein, 643 aa, Asplenium nidus var plicatum
MASAVGRFAAAQAQSSEAAQPQIASSSALSIAQQAVDALGRGYDVNFDLRLGYCKQRKHLIENDELGPTQDLLLPGNISIPNLPASIKCDKGDRARLTTEVLTFNEMSEHINQNLSISGKIPTGHFNNLFDFSGSWQKDASQVKTLALDGFFINLYTVELPRAQLTLKEEVRAAVPSSWDPAALASFVEKFGTHVIVGVKIGGKDVICLKQHHSSQLSAVGVQKILEAKAKERFTSIVGGTSRENNKGKIMDGFTYGSNATNTVNGSKDGLHPSWLDSSFSDHPPVETDDVKVMFKRKGGRAVSQSHEEWLHTVPSSPDIVSMSFVPITSLLNGVTGTGFLSHAINHYLRYKPPIDQLRHFLEFQLPKDWAPAFGDLPLGPPRKQQASPSLQFRLMGPKLQVNTTPVTVGKRCVTGIRLHLEGKKSNRLAIHLQFLTVVPQILQSRWEDDQLEDWEGPDTDFSKYFEPVMWRSFSHVCTAPVESREPWAADEMAGEAALRGALVVTGAQLDVEQHGSKKVLFLRLLYSKIHKATNRRSEWDHTPASSQRSGIFSSLISTPFSSAAASPAAAKPVHVNSAIYPDGPPPANSQAPKLLKFVDTSEMTRGPLDLPGHWLVTGAKLCVERGKIAVRAKYSLLLYSED

SEQ ID NO: 444 - protein, 427 aa, Verbascum chaixii (Vill)
MAYYGHSNARLDAKAAAEKAVSVIGFGYDLTSDIRLSACKPGPSGSGLIELERSRTKDLVVPGNVVVSNVSGSIKCDKGERTRFSSDALTFNQMSEHFNQELSLSGKIPSGLFNTMFGFKGCWQNDASTSKILAFDGWLISLYTIELERSQITLSDKVKQEVPSTWDPPALAEFIEKYGTHVIVGVKMGGKDAIHIKQLKNSNLQPTEVQKLLKQLADEQFSEDGNEDPTADSDISSGKSKVQQSLIWDLQIPFTSTVRPPVVSHSKTDDLLSIHIRRGGLDSGQSHKKWLSTVSQYPNVISMSFVPIASLLSGTRGSGFLSHAINLYVRYKPPLEELTQFLEYQLPRQWAPAYNDLPLGHCRRKKASPSLQFSLLGPKLYVNTVKVDTGNRPVTGLRLYLEGKKSDHLAIHLQHLSTLPQSCCLCV

SEQ ID NO: 445 - protein, 520 aa, Verbascum chaixii (Vill)
MALKLPAAEAAKVAIHSIGCGYDISLDLRLKYCKGDSSLIEIDEDHGREIVLPGGVTIPNVPKSIKCDKGERTRFRSDVLTFQQMSEQLNQELALTGKIPSGLFNAMFEFSGCWQKDAAYTKTLSFDGMFITLYTVALEKSHMVLRDNVKKEVPSSWDPASLARFISKFGTHVIVGLKMGGKDVIYMKQQHSSSLQSADVQKRLKAMADKRFLDANGQSELNSEQLYQSGKLEMKESRLRFADTGSSSSYSHKDDIVSICKRRGGTDGRNLNHKEWLQTVQSEPDVISMSFIPITSLLNGVSGSGYLSHAINLYLRYKPPIEEVHQFLEFQLPRQWAPVFSDLPLGPQRRQQSTASLQFSLLGPKLFVNTSAVDVGKRPVTGLRLYLEGRRSNRLAIHLQHLSSLPNIFQLEDDPNGNFRQESHDRRYYEKVQWKNFSHICTAPVESDEELSIVTGAQLQVGDYGFKKVLFLRLRFSTVLGAVSVKYPEWDGSPGLARKSGLISTLISHHFTAVQKPSPN

SEQ ID NO: 446 - protein, 600 aa, Symphoricarpos x chenaultii (Hancock)
MALKLSAPEAAKVAIQSIGCGYDISLDLRLKYCKGDSVNPRLIEIDEDQGREVVLPGGIVIPNVSKSIKCDKGERTRFRSDVLSFQQMSEQFNQEMSLTGKIPSGLFNSMFLFSGSWQKDAANTKTLAFDGVFITLYTVALGKSQMVLCDHVKKAVPSSWEPAALARFIERFGTHIIVGVKMGGKDVIYVKQQHSSSFQPADVQKRLKTIADKRFLDANGQYGVDSEQTYQNDKFENRQHRLRFADTSPSSSYSYKEDIARICKRRGGSDNEALSHNEWLHTVQLEPDAISMSFIPITSLLNGVTGSGFLSHAINLYLRYKPPIEELHQFLEFQLPRQWAPVFNELPLGPQRRQSTSSLQFSFMGPKLFVNTTPVDVGKRPVTGLRLYLEGKRSNRLAIHLQHLSSLPRVFQLEDDPNGNFRHESYDRKYYEKVQWKNFSHVCTAPVESDEDLSIVTGAQLQVGDYGFKKILFLRLRFSTVIGAASIKHPEWDGSPGLARKSGLISTLISHHFTTVQKPAPQPADVNINSAVYPGGPPTPVQALKLLKFVDTTEMTRGPQESPGYWVVSGARLVVEKGRISLRVKYSLLTIIPDEEVLEE

SEQ ID NO: 447 - protein, 601 aa, Adiantum pedatum
MASEREAARTAALVAVESLGCGFDLTSDYRLKYRKGPLLQLQHNSIKDLTIPGGITIPDVSRDVTCDKGERMRFASEVMQFQQMSQWFNQNASVEGKIPLGLFNAMFDLSGSWQDDANQIKNLAFDGCFITLYKLHLTRSNLVIRDDVINDIPSVWDPQGLARFIEKYGTHIIVSASVGGQDVLYLKENQSSLLSPQDIHKQLKSAGDDYFLDKDADRSLNVKDSETLPLNSLKGQPSRATVAHIHSAQLLISNKDFTIISQRRGGHYFCKSHSEWQETVNVFPEAISLSFVPIASLLLGVAGCGFLQHAINLYLRYKPPVSDIQYFLDFQVPRQWIPSHNELPLRLARKQAFSPSLQFSFMGPKLYINSSEVVVDGKPVTGLRLFLEDRKSNRLAIHLQHLSVLPQSLGKFWSEDTHKESPRWNGSNDAAKDWFEPVEWKCFSHVCTQPVKYKPEWLDVKGSAFVVTGARLEVKVHGLKSVLHLHLLFSNIPGCVIQRSRWDQPPAAEKTSFFSSLSTTFSSTARPGKKGPQVVVDSAVFVGGPPRPIQSPTLLKYVDTTELTRGPQDAPGHWVVTAARLELDKSKISLRVKFSLLSYME

SEQ ID NO: 448 - protein, 637 aa, Dryopteris erythrosora
MASALGGLATLPPQSSEAASLAFSVAQQAVDALGRGYDVNSDLWLRYCKRGERLIENDKSGPTQDLLLPGNIAIPNVSTSIKCDKGDRTRFTSDILTFNEMSEQFNQNLSIAGKIPVGHFNAMFGFSGSWQKDASMVKTLAMDGVFINLYSVELPRAQLTLKEEVRAAVPSSWDPAALASFVEKYGTHVIVGVKIGGKDVICLKQHRSSSLSAVGVQKILQSKARERFSSVDGCAAKEKINKGKIRDGSPYGSNGINAVNVLKDGMPLPWISDSSTDLSTVETDDVTVIFKRKGGRDASQSHAEWLHTVASTPDIVSMSFVPITSLLNGVTGTGFLSHAINHYLRYKPPIQELHHFLEFQLPKEWAPAFGDLPLGPPRKQAGSPSLQFRLMGPKLQVNTTPVVIGKRCATGLRLHLEGKKSNRLAVHLQYLTVVPQILQRLWEDDQPEEWEGPDDDFSKYFEPVMWKSFSHVCTAPVESSESWEDEGKGEAGPKGALVVTGAQLDVEQHGSKKVLFLRLLYSKIHKARIRRSEWDHTPASQQKSGIFSTLMSTTFSSAQAAPPKPVQVVVNSAIYPQGPPPTKSQAPKLLKFVDTTEMTRGPLDLPGHWLVTGAKLFVDRGKIAVRAKYSLLLYSVD

SEQ ID NO: 449 - protein, 301 aa, Marsilea mutica
MSEHFNKSLSITGKIPLGHFNSMFQFSGSWQKDASSVKALAYDGVFKSLYSLQMPTTLLTLKEEVKASMPSSWDPRALANFIENYGTHIIVGVTIGGRDVVCLKQLHGSSLSGDRVRKFLESSANERFLASGVSSHNAKGNSHKDDIGYNFINNVAMNEETILKDDMVNIIRKQRGGKQCLQSHKEWLQTVKDFPDILSMHFVPITSLLTGVTGSGFLNHAINLYLRYKPPIEELRYFLEFQLPKEWAPAFGDLPLGPPRKQIESPALQFRFMGPKLQVNTTQVTVGKRPVTGIRILFVCA

SEQ ID NO: 450 - protein, 387 aa, Phormium (Lancer Terra Cotta)
MEGEGEPVEIMALKALGLGFDLTNDFRLRFAKGWYPYRRLVELDEGNTRDIVIPGNLTIRDVPVDVGCDKGDRIRFRSDVLEFNQMSELLNQKSSIQGKVPSGYFNALFDLSGAWLDDAKNTKHLAFDGYFISLYNLHLRSSPLVLRDEVKKAVPSKWEPVLLSRFIRTYGTHIIVEMAVGGQDVICVKQSHSSTISTAELKLHLEDLGDILFSDGRNLSPLHRKGREGRNKVPDIFFKILQSNNLQLASYSETSSKDGITVICSKRGGDAYLCNHSKWLQTVPITPDAILFKFVPITSLLTGIPGSGYLSHAINLYLRYKPDPQDLQYFLEFQVPHQWAPMFNDLTLGPQRRKAFYPSMQFRFLGPRLRVNATQVLFILITCAYNL

SEQ ID NO: 451 - protein, 639 aa, Polystichum polyblepharum (Roeme x Kunze)
MASAVGASRLQSSEAAPSQNISSLAFSVAQQAVDALGHGYDVNSDLWLRYCKRGERLIENDKSGPTQDLLLPGNIAIPNVPTSIKCDKGDRTRFTSDILTFNEMSEQFNQNLSISGKIPVGHFNAMFGFSGSWQKDASLVKNLAMDGVFINLYSVELPRAQLTLKEEVRAAVPSSWDPAALASFVEKYGTHVIVGVKIGGKDVICLKQHRSSSLSAVGVQKILQSKAKERFSSVDGCAAKEKINKGKIRDGSTYGSNGMNAVNGLKDGIPLPWISDSSADLSTVETDDVTVLFKRKGGRDVQSHDEWLHTVASTPDIVSMSFVPITSLLNGITGTGFLSHAINHYLRYKPQIQELHHFLEFQLPKEWAPAFGDLPLGPPRKQAGSPSLQFRMMGPKLQVNTTPVVIGKRCVTGLRLHLEGKKSNRLALHLQYLTVVPQILQQLWEDDQPEQWEGPEDDFSKYFEPVMWKSFSHVCTAPVESSETWEDEGKGEAGPKGALVVTGAQLDVEHYGSKKVLFLRLLYSKIHKARIRRSEWDHTPASQQRSGLFSTLMSTTFSSAQSAPQKAVQVVVNSAIYPQGPPPAKSQAPKLLKFVDTTEMTRGPLDLPGHWLVTGAKLFVDRGKIAVRAKYSLLLYTVD

SEQ ID NO: 452 - protein, 513 aa, Polystichum polyblepharum (LW12418)
MASAVGAWPLQSSEAAPSQNISSLAFSVAQQAVDALGHGYDVNSDLWLRYCKRGERLIENDKSGPTQDLLLPGNIAIPNVPTSIKCDKGDRTRFTSDILTFNEMSEQFNQNLSISGKIPVGHFNAMFGFSGSWQKDASLVKNLAMDGVFINLYSVELARAQLTLKEEVRAAVPSSWDPAALASFVEKYGTHVIVGVKIGGKDVICLKQHRSSSLSAVGVQKILQSKAKERFSSVDGCAAKEKINKGKIRDGSTYGSNGMNAVNGLKDGIPLPWMSDSSADLSTVETDDVTVLFKRKGGRDVQSHDEWLHTVASTPDIVSMSFVPITSLLNGITGTGFLSHAINHYLRYKPQIQELHHFLEFQLPKEWAPAFGDLPLGPPRKQAGSPSLQFRMMGPKLQVNTTPVVIGKRCVTGLRLHLEGKKSNRLALHLQYLTVVPQILQQLWEDDQPEQWEGPEDDFSKYFEPVMWKSFSHVCTAPVESSETWEDEGKGEAGPKGALVVTGAQLDVEDMGR

SEQ ID NO: 453 - protein, 400 aa, Platycerium bifurcatum
MASAKEAAALAAVEALGCGFDLTSDYRLKYKKGSLLELQHSHNKDLTIPGCITIPDVSRGIKCDKGEHMRFTSEVMQFQQMSQWFNQNASVEGKIPLGLFNAMFDLSGSWQDDANRLKNLAFDGCFITLYKLHLTRSNLVLREEVKNDIPSVWDPKSLAKFIEKYGTHIIVSASVGGQDVLYLKENYSSLISAQEIRKKLKSAGDEYFSETSGKRNADFKHSETSPLNSQPFRGTIAKSAGDEYFSETSGKRNADFKHSETSPLNSQPFRGTIAGSAQLLISNKDYTLISQRRGGYYFAKTHCEWQETVNMYPEAISLSFIPITSLLLGAVGSGFLQHAINLYLRYKPPVSDLQYFLDFQVPRQWIPVHKKQSHYPSFQLHLYYWVRLEAAFCSMRSIFI

SEQ ID NO: 454 - protein, 608 aa, Sphaeropteris cooperi
MASKQHKPDAETVAKLAIQALGRGYDITCDLRFSSCKDANGTSLIELNDEKTQELSLPGGIVVPNVPTIVKCDKGERTHFRSDILTFDQMSQQFNQGLSLSGKIPSGLFNSMFQFTGAWQKDASTAKHLALDGWFYTLYTVEMPRSQLVLKEDLKALVPSSWDPVVLARFIETYGTHIIVGVKVGGKDVVYLKQHPSSPLTPVGFQKLLAEVSDERFSQVEGRSSMGSKENHNNKKRIIESYSWSAQMDTLSQMFSNEKQYVTIIPRRKGGHDSAHTHSEWIYTVPLAPDVISMSLIPITSLLSGVTGSGFLSHAVNLYLRYKPPIEELRQFLEFQLPRQWAPVFNELPLTLSRKERSPSTLQFSLMGPKVKVSNMQVTVGKTPVTGMRLYLEGKKCDKLAVHLQHLSAVPKVLQPLWEEHPFAGEPTWQDPEDYNSRYFEAIQWKNFSHVCTAPVENTDTWIGDHAGASVVVGAQLRVSSFGIKNVLYLRLLYSKIPEAKIRRSEWDHMPASMQKSGMFSTLLSTTFSSTPPPPKAPAVVMNSGVYPEGPPKPVQEPKLLKYVDMTEMTKGPQDMPGHWLVTGAKLYLDNRKISLRVKYSLLTISSD

SEQ ID NO: 455 - protein, 259 aa, Tupidanthus calyptratus
MGGKDVIYMKQQHSSSLQPSDVQKRLKTIADKRFVDASGQYGMDSEQTHQNDKFQIREQRLRFADTSPSSSYSYKEDIVIICKRRGGSDNKNLTHNEWLHNVQLEPDVISMSFIPITSLLNGVSGSGFLSHAINLYLRYKPPVEELHQFLEFQLPRQWAPVFSDLPLGPQRRQQSTSSLQFSLMGPKLYVNTTPVDVGKRPVTGLRLYLEGKRSNRLAMHMQHLSSLPKIFQLEDDPNGNFHQESYDRRYYEKVQWKNL

SEQ ID NO: 456 - protein, 264 aa, Tupidanthus calyptratus
MYPNKLIVIKVSGYDLALTVSLSSRCQSNSIRKYLFLAKFQQAISTLHFNSLGVGFNAAFQFTGCWQKDAANTKTLALDGVFITIYTIALEKSQITLCDHIKEAVPSSWDPAALARFIEKFGTHVIVGVKMGGKDIVYMKQQHSSPLQSDEVQKRLKHVADNRFSNASGHSTNPEKVYEREMLEINEPPQEFMDDSASSSYMDLEDITFFYRRRGGSNKKNLPHDKWCQSVQLEPDVISMSFIPISSLLSGINGNGFLTHAINL

SEQ ID NO: 457 - protein, 639 aa, Blechnum gibbum
MASAVGGLAAMQAQSSEGAPLQNTASLAFSVAQQAVDALGRGYDVNSDLWLRYCKRGERLIENDNSGPTQDLLLPGNIIIPNVSTSIKCDKGDRMRFTSDVLTFSEMSEQFNQNLSISGKIPVGHFNAMFGFSGSWQKDASQVKTLAMDGVFINLYSVELPRAQLTLKEEVRAAVPSSWDPAALASFLEKYGTHVIVGVKIGGKDMICLKQHRSSTLAAVGVQKILEAKAKERFSSVEGSAAKEKINKGKIRDGSAHEANGMNAVFGSKDGMPLSWMNDTAPDLENDDVTVICKRKGGKDISQSHDEWLDTVPSTPDIVSMSFVPITSLLNGVTGTGFLTHAINHYLRYKPPIQELHHFLEFQLPKEWAPAFGDLPLGPPRKQQGSPSLQFRLMGPKLQVNTTPVVIGKRCVTGLRLHLEGKKSNRLALHLQYLTVVPQILQRLWEDDQTEEWEGPDDDFGKYFEPVMWKSFSHVCTAPVESNEIWVDEAKGEHGPKGALVVTGAQLDVEQHGSKKVLFLRLLYSKIHKAKIRRSEWDHTPASQHKSGIFSALMSTPFTAQAAPVKPVHVVINSAIYPQGPPPAKSQAPKLLKYVDTTEMTRGPLDLPGHWLVTGAKLFVDNGKIAVRAKYSLLLYSVD

SEQ ID NO: 458 - protein, 534 aa, Platycerium wandae
MSEQFNQNLALSGKIPVGHFNAMFGFSGSWQRDASAVKNLAMDGVFITLYSVELPRSQLTLKEEVKAAVPSSWDPAALASFLEKYGTHVIVGVKVGGKDVICLKQHRSSSLSAVGVQKILEAKGKERFSSVEGSTAKEKINKGKIRDGSLFGSNGLNALNGSKDLPWMSDSSTDFSTVETEDVTVIFKRKGGRDRSQSHDEWLLTVPLFPDVVSMSFVPITSLLSGITGTGFLNHAINHYLRYKPPIQELHHFLEFQLPKEWAPAFGDLPLGPPRKQAGSPSLQFRLMGPKLQVNTTPVVIGKRCVTGLRLHLEGKKSNRLAIHLQYLTVVPQILQQLWQDDQSEVWEGPDEDASKYFEPVMWKSFSHVCTAPVESTETWEDEGKGDPESKGAQVVTGAQLDVLQCGSKKVLFLKLLYSKIHKARVRRYEWDHVPASQQKSGIFSTLMSTTFSSVQASPQKPVQVVVNSAIYPQGPPAANSQAPKLLKFVDTSEMTRGPLDLPGHWLVTGAKLFVDRGKIAVRAKYSLLLYSVD

SEQ ID NO: 459 - protein, 604 aa, Equisetum arvense
MTAQSRAREAVQALGRGYDVIHDLRLTYCKGDPGSCLVKLEQSQTQDLVIPGGIVIPGVSKSITCEKGERTRFKSDVLSFQQMSEQFNQWLSVPGKIPLGLFNATFGFSGHWQKDASSVKNLAMDGWLITLFSVELPKSHLVLREEVKKDVPSSWDPSALASFIEKYGTHIVVGVKIGGKDVVCVKQHQSSSVSAVDIQGLLKRKADERFAKTESDDVLNPEQKLDTEQNFMLNQSNRFQIYNVPSPVFSTKEDATTLCSRRGGNEMVQSHNQWLQSVTGSPDVILMNFVPITSLLNGVAGSGFLSHAVNLYLRYKPPVEELLHFLEFQLPRQWAPVYSELPLGPPRRECTTSSLHFSLIGPTLYVNTAPVNVGRRPVTGLRLYLEGRRCNRLAIHVQHLSAIPRVLHPLWEDHPFAADPKWQGPEELDPRYLEPVFWKNFSHVCTAPVENGDHWMGDSTSGSGAGAHVVIGARLGVRGVGLKNVLFLDLLYSKIPQAKVRRSEWDHTPAALQKSGFFSTLMSTTFSAPQQPIAKPAPINLNSGVFPGGPPVPVRMPKLLKFVDTSELTKGPQDMPGHWLVTGAKLYLDAGKISLRVKYSLLIY

SEQ ID NO: 460 - protein, 616 aa, Phormium (Lancer Terra Cotta)
MALKFPPRKAAEFAINSIGLGYDVAADIRLKYCKRETQDPCLIELDKDQLQDIVLPGGITVSNVPKSIKCDKGERTRFRSDVLSFQQMSEQFNQELSLSGKIPELSLSGKIPSGLFNYMFEFSNCWQKDAANTKSLAFDGWFITLYTVALAKSQIVLRDHVKQAVPSSWDPAALARFIEKFGTHVIVGVKMGGKDVIYVKQQHFSNLQPAEVQKILKDMADKRFLDVSGQYGMNSEEAFGKDKFDFKEQRLRFADSSSSSSYSTKEDIVRIFKRRGGNDNKDLPHPEWLNTVQYEPDVISMSFVPITSLLQGIPGSGFLSHAINLYLRYKPPTEELHQFLEFQLPRQWAPVFSDLPLGPQRKHQSTASLQFTFMGPKLYVNTSVVDVGKRPVTGLRLYLEGKRSNRLAIHLQHLSSLPRIFELREDPSSSYSRESHDRKYYEPIQWRHFSHVCTAPIEADEDNSIVTGAQLHVGHYGLKKVLFLRLHFSTVSNVTLVRNHEWDGSPGLAHKSGLISTLISTRFTAAIQKPPPRPADVYINSAVYPGGPPVPVQTPKLLKFIDTTEMVRGPQNPPGYWVVSGAKLQLERGKISLRVKYSLLTVLLPDDDDDDDDDDV

SEQ ID NO: 461 - protein, 516 aa, Doellingeria umbellata
MRFSSDILSFQQMSEQFNQEVSLSGRIPTGQFNAAFEFTGSWQKDAANTKALAIDGVFITLYNVTLEKSQIALCDHVKNAVPSSWEPAALAKFIENFGTHVIAGVKMGGKDTVYMKQQHSSTLTSDDVQRKLKDVAEKRFSGHHNDNPRKARDLEPLERNDYGLITLDPAIEDITFFWRRRGGSYGKNLDHRTWCQTVQLEPEVISMTFIPITSLLSGIDGNGFLTHAINLYIRYKPPIEELQQFLEFQLPTRWAPEFGELAVGPEGKPHHSASLQFRFMGPKLYVNTNQVDVGNNPVTGLRLYLEGKRNDCLAIHLQHLSSIPKSFKLMLEPNTNLAPNFHDRRYHEKVQWKSFSHICTAPVESDDELSIVTSAEFEVSDSGVKRVLFLRLRYAKVVGATVVRKPEWDGSPVLSQKSGIVSALISTRFSNAQKPPPQPKDIVVNSALPIGPPISAQGKKLLKFVDTTELVRGPQDLPGYWVVSGARLMVDKSKISLRAKFSLLAVISGNEETYSG

SEQ ID NO: 462 - protein, 380 aa, Tupidanthus calyptratus
MDSEQTHQNDKFQIREQRLRFADTSPSSSYSYKEDIVIICKRRGGSDNKNLTHNEWLHNVQLEPDVISMSFIPITSLLNGVSGSGFLSHAINLYLRYKPPVEELHQFLEFQLPRQWAPVFSDLPLGPQRRQQSTSSLQFSLMGPKLYVNTTPVDVGKRPVTGLRLYLEGKRSNRLAMHMQHLSSLPKVFQLKDDPNGNFRQESYDHRYYEKVQWKNFSHICTAPVESDEDLSIVTGAQLEVGDYGFKRVLFLRLRFSTVLGAVAVKHPEWDGSPGLARKSGLISTLISHHFTATLKPPPQPADVNINSAIYPGGPPAPTQSAKLLKFVDTTEMTRGPQETPGYWVVSGARLMVEKGRISLRVKYSLLTVILPDEEALEEP

SEQ ID NO: 463 - protein, 298 aa, Waldsteinia ternata
MRFGSDVLSFQQMSEQFNQELALSGKIPSGHFNTAFEFTGGWQKDAANTKTLAFDGVSITLYSVALEKSQVSLREQVKQDVPSSWDPTALARFISKYGTHVIVGVKMGGKDTIYAKQMYSSPVQPADVQKKLKDMADKMYVDGNSHSGVTSEKFHERDKFIKEQGLGIMNAIPSSSYASVESQDIKFVCKRKGGSLHKNLRHSEWSQTVQLEPDVISMSFVPITSLLSGIHGSGFLTHAINLYLRLQTNHQLKNCINFWISKFQGNGHQCLVSLLLVPRGGKKVLHLYSLASWVPSFM

SEQ ID NO: 464 - protein, 407 aa, Sphaeropteris cooperi
MMSSADVHKLLKEFGDQMFAKKGGQKMQDGNHLSRRSIAPDETMYVDGTKSLFKNKDVTIFTKMRGGLLSAKTPTQWQATVTSTPDVIMMSFVPITSLLSGTPGSGFLNHAINLYLRYKPPIEDIRCFLEFQVPRQWAPVYSDLPLGPPQRAITLPSLQFCLMGPRLYVNTAQISVGRKPVTGLRLYLEGRQNNRLAIHLQHLASLPRVLEPYWNPEIHEQSNWHGSDNVESSEWFEHVQCRTFSHVCTARVKYNPVWTRSKSGVFVVTGAQLEVKSYGLKNVLHLRLQFSRIPGCTILKSRWYQPCSSNLSEKSRFFSTLSTAFTSHMVKKPVQPSPVVVDSGVFLGEPPIPIQQPKLLRFVDTRELTKGPQDMPGHWLVIGAQLDVDGGKISLNAKYSLLNFDFK

SEQ ID NO: 465 - protein, 582 aa, Nephrolepis obliterata
MASKLDIPNAAKVANIAIQSLGRGYDLTCDLRFSTFKDVNGASLIELRNNETLELSLPGGVVVTNVPAIVKCDKGEQTHFRSDIVTFDQMSQQFNQGLSLSGKIPSGLFNYMFNFTGSWQKDASTTRHLALDGWFYTLYTVEIPRSQLVLKEDIKASVPTSWEAAALARFIETFGTHIIKLLAEVSDERFAQTEGRTSVGSKDGRINKKKRGIEIQSWAAHLDTFSQITYNEKHHVTIIPRRKGGFDHGQSHSDWIHTVPLAPDIISVSLIPITSLLHGVSGSGFLSHAVNLYLRYKPPIEELRQFLEFQFPREWAPVFSELPLTLSRREHSVSTLQFTLMGPKLKVSKLQVTVGKKPVTGMRLFLEGQRCDKLAIHLQHLSAVPRFLQPLWEDHPFAREVTWQDPDDCSTKYFEPVQWKNFSHVCTAPVENMETWIGDHAGACVVIGAQLAVKSFGLKNVLYLRLLYSKIPEAKIRRSEWDHMPASTQKSGMFSSFLSSTFSSAPAPTKVPAVVINSGIYSEGPPKPVRDPKLLKFVDTTEMTKGPQDMPGHWLVTGAKLYLDKGKISLRVKYSLLTVSSD

SEQ ID NO: 466 - protein, 311 aa, Waldsteinia ternata
MRFGSDVLSFQQMSEQFNQELALSGKIPSGHFNTAFEFTGGWQKDAANTKTLAFDGVSITLYSVALEKSQVSLREQVKQDVPSSWDPTALARFISKYGTHVIVGVKMGGKDTIYAKQMYSSPVQPADVQKKLKDMADKMYVDGNSHSGVTSEKFHERDKFIKEQGLGIMNAIPSSSYASVESQDIKFVCKRKGGSLHKNLRHSEWSQTVQLEPDVISMSFVPITSLLSGIHGSGFLTHAINLYLRYKPPVEELHQFLDFQVPRQWAPVFGELALGPQRRQESTASLQFSFMGPKLYVNTNPVCYHYYFFLF

SEQ ID NO: 467 - protein, 618 aa, Nephrolepis cordifolia (Duffii)
MQPQSSAAAPPQNTPFSVAQQAVGALGRGYDVNSDLWLRYCKRGAQLIENKPGPTQDLHLPGNIVIPNVPSSVKCDKGDRTRFTSDILTFNEMSEQFNQNLSISGKIPVGHFNAMFGFSGSWQKDASVVKTLAMDGVFITLYSVELPRTQITLKEEVRAAVPSSWDPAALASFVEKYGTHVIVGVKIGGKDAICLKQHRSSSLSAVEVQKILETKAKERFLSVEGNTAKERINKGKIRDGSPYGSNGMAALNLSKDETTLSWLSDTSTDHSTVETNDVTVIFKRKGGRENSTSHDEWLHTVASFPDIVSMSFVPITSLLNGITGTGFLSHAINHYLRYKPPIQELHHFLEFQLPKEWAPAFGDLPLGPSRKQPGSPSLQFRLMGPKLQVNTTPVVIGKRCVTGLRLHLEGKKCNRLAIHLQYLTVVPQILQQLWEDDQPEDWEGPDDDFSKYFEPVMWKSFSHVCTAPVESTETWEDEGKVEPGQKGALVVTGAQLDVEQYGSKKVLFLRLLYSKIHKARIRRSEWDHTPASQQKSGIFSTLEDSEVRVGSHTGVTAEIRHLQHSYEHYLLFSADSSTEASASGCQLCHIPPGPATCQKPGTQALEVCRHDRNDKGAS

SEQ ID NO: 468 - protein, 258 aa, Platycerium hillii
MAKRRFCSEGQKDASAVKNLAMDGVFITLYSVELPRSQLILKEEVKAAVPSSWDPAALASFLEKYGTHIIVGVKIGGKDVICLKQHRSSSLSAVGVQKILEAKGKERFSSVEGSTSKEKINKGKIRDGSSFGSNGMNALNGSKDLPWMSDSSTDYSTVETEDVTVIFKRKGGRDRSQSHDEWLHTVPLFPDVVSMSFVPITSLLNGITGTGFLNHAINHYLRYKAPIQELHHFLEFQLPKEWAPAYGDLPLGPPRKQA

SEQ ID NO: 469 - protein, 369 aa, Lygodium flexuosum
MENSESFSLMEDSSTFSIDGDVTVIYKRKGGSESCQSHNDWLHTVPLAPDVVSMSFVPITTLLNGVPGTGFLSHAINLYLRYKPPLQELSNFLEFQLPKEWAPAFGDLPLGPPRKQQEVPSLQFRLMGPKLHINTTPVVVGKRPVTGLRLYLEGKKSNKLAIHLQYLTAVPQILKTLWVEDGGGEEEWVGPEADFSKYLEPVQWRNFSHVCTAPVENSETWLGGPGGALVVVGARLQVQQYGAKKVLFLHLLYSRIAKARIRRSEWDHMPASQQKSGLFSTLISTTFSSAAAQSPAPPKPVVINSAIYPEGPPVPGQMPKLLKFVDTTEMTRGPHDLPGHWLVTGAKLLLERGKISLRAKYSLLLYSVE

SEQ ID NO: 470 - protein, 608 aa, Polystichum polyblepharum (LW12418)
MAFKHDIPNAAKVANIAIQSLGRGYDLTCDLRFSTCKDVNGTPLIELRNNETLELSLPGGVVVANVPSIVKCDKGERTRFRSDILTFDQMSQQFNQGLSLSGKIPCGLFNYMFNFTGSWQKDASTTRHLALDGWFYTLYTVEIPRSHLVLKEDIKASVPTSWEPAALARFIETFGTHLIVGIKIGGKDVVYMKQHQSSPSTSVDFQKLLAEVSDERFLQTEGRASVGSKDSRSNKKRSIEFQSWSAHLDTFSQIIHNDKHHVTIIPRRKGGFDHGQSHSEWIHTVPLAPDVISVSLIPITFLLNGVAGSGFLSHAVNLYLRYKPPIEELRQFFEFQLPREWAPVFNELPLTLPRREHSPSTLQFTLMGPKLKVSKLQVTVGKKPVTGMRLFLEGKRCDKLAIHLQHLSAIPRFLRPLWEDHPFAREVTWQDPDDYSTKYFEPVQWKNFSHVCTAPVENTETWIGDHAGASVVVGAQLAVKSFGLRNVLYLRLLYSKIPEAKIRRSEWDHMPASTQKSGMFSSFLSTTFSSTPFPTKGPAVVINSGIYPEGPPKPVRDPKLLKFVDTTEMTKGPQDMPGHWLVTGAKLYLDKRKISLRVKYSLLTVRSD

SEQ ID NO: 471 - protein, 395 aa, Tupidanthus calyptratus
MFSDGRNPVLERKTRDGKQKVPEVFNRMLQSHTMQFSSITETSSKDGLTILSSKRGGDVFSQNHSNWLQTVASNPEAICFKLVPITSLLTGVPGSGYLSHAINLYLRYKPAPEDLRYFLEFQVPVQWAPLFCELPLRHQRRKASCPLLQFAFLGPKIHVSSTQVTSGEKPVVGLRLFLEGKKCNRMAIHAQHLSSLPNIMEFALSNSATSRPCQWRGSDDYISNDQFLEPVRWKRYSNVCSSVVEHDSNWIQGEEVGAFVVTGAQLISKGKWPKTILHLRLLFSYLPNCTIRKTEWAAAPEASQKSGFRLNLSTTFTFSQRTGADAPKQLPAALNSGVYPEGPPVPLRSKKLLKYVDVAEVVRGPHDTPGHWLVTAAKLVTDGGKIGLHVKFALL

SEQ ID NO: 472 - protein, 374 aa, Tupidanthus calyptratus
MEEEGGKPIEVIAMESLGLGFDFASDFKLKFAKRCPDGAGDDGRLVVIDEANKRDVVFPGGGVIRGVPESIRCGKGDRIRFKSDVLKFNQMSELINQKSSVQGKVPSGYFNAMFDLSGSWFNDAADSNHLAFDGYFISLYYLHLIASPLVLRDKVKNSVPSHWNPASLSRFILTYGTHVIVGLAVGGRDLICVKQRQSSGIPPAELRGYLEDLGDCLFSDGKSPLLERKARDGKQNVPEVFTRMLQSNTKHFTSITETSSKDGLTIILSKRGGDVFSQNHSNWLQTVASNPEAICFKLVPITSLLTGVPGSGYLSHAINLYLRYKPIPEDLQYFLEFQVPRQWAPLFCEMPLGHTEQRLLVLRCNSLSWVPRFM

SEQ ID NO: 473 - protein, 264 aa, Asplenium prolongatum x Asplenium antiquum (Kurata)
MSSTAFSIAQQAVDALGRGYNVNFDVSLSYGKQGKRLIEIDESGPTQDLLLPGNIIIPNMPASIKCDKGERTRFTTEFLTFNEMSELFNQNLAISGKIPTGHFNTMFDFSGSWQKDASQVKTLALDGFFINLYTVELPRAQLTLKEEVRAAVPSSWDPAALASFVKKYGTHVIVGVKIGGKDVVCLKQHRTSQLSTVRVQKILEEKAKERFTSIAGGTSKEKINKGKDVRVMFKRKGGKDVSQSHEEWLHTVPAAPDIVSMSFV

SEQ ID NO: 474 - protein, 314 aa, Tupidanthus calyptratus
MEGGEETVKPIGLRAMESLGLGFDFASDFRLKFAKRCPGAGGDDRLVVLDEASRRDVVFPGGGVIRGVPECIRCDKGDRIRFKSDVLKFNQMSELVNQKSSVQGKVPSGYFNAMFDLSGSWLNDAADANHLAFDGYFISLYYLHLIASPLVLRDKVKNSVPSHWNPASLSRFILTYGTHIIVGLAVGGQDVICVKQRPSSGIPPAELRGYLEDLGDCMFSDGRNPVLERKTRDGKQKVPEVFNRMLQSHTMQFSSITETSSKDGLTILSSKRGGDVFSQNHSNWLQTVASNPEAICFKLVPITSLLTGVPVSTL

SEQ ID NO: 475 - protein, 679 aa, Blechnum brasiliense
MASAVGGLAAMQAQSSEGAPLQNTASLAFSVAQQAVDALGRGYDVNSDLWLRYCKRGERLIENDNSGPTQDLLLPGNIIIPNVSTSIKCDKGDRMRFTSDVLTFSEMSEQFNQNLSISGKIPVGHFNAMFGFSGSWQKDASQVKTLAMDGVFINLYSVELPRAQLTLKEEVRAAVPSSWDPAALASFLEKYGTHVIVGVKIGGKDMICLKQHRSSTLPAVGVQKILEAKAKERFSSVEGSAAKEKINKGKIRDGSAHEANGMNAVFGSKDGMPLSWMNDTAPDLENDDVTVICKRKGGKDISQSHDEWLDTVPSTPDIVSMSFVPITSLLNGVTGTGFLTHAINHYLRYKPPIQELHHFLEFQLPKEWAPAFGDLPLGPPRKQQGSPSLQFRLMGPKLQVNTTPVVIGKRCVTGLRLHLEGKKSNRLALHLQYLTVVPQILQRLWEDDQAEEWEGPDDDFGKYFEPVMWKSFSHVCTAPVESRLWEDDQTEEWEGPDDDFGKYFEPVMWKSFSHVCTAPVESNEIWVDEAKGEHGPKGALVVTGAQLDVEQHGSKKVLFLRLLYSKIHKAKIRRSEWDHTPASQQKSGIFSSLMSTTFTAQAAPVKPAHVDINSAIYPQGPPPAKSQAPKLLKYVDTTEMTRGPLDLPGHWLVTGAKLFVDRGKIAVRAKYSLLLYSVD

SEQ ID NO: 476 - protein, 556 aa, Schizophragma hydrangeoides
MVPGFGSFKHVSIDIKCDKGDRTRYQSDRTRYQSDILDFNQMSEFINQKCSIPGKIPSGLFNAMFGFQSGSWVVDAANTKYLGLDGYFIIVFNVHIDRYPLILSDEVRNAVPSTWDPSALARFIEKYGTHIIVGLSMGGQDVVLVRQERSSNLEPSQLKNHLENLGDQLFTGACTFSPNHCKTKELSNKAPQAFNIFGSKMLFNSFSCISAKDGIIVICSKRGGDSSANSHCEWLPTVASMPDAIQFSFIPITSLLKGVPGKGFLSHAINLYLRYKPPLADLPYFLDFQAHKMWAPTHNDLPLGPTTNRAISTPALHFNFMGPKLYVNTSQVTVGKTAVTGMRFYLEGMKCNRLAIHLEHLSTTPILLQNKIDDQKTWRGSEELADCRYFEPIQWKNFSHICTSPVKYDPKWATRKDVAFIVTGAQLQVKKHDSKSVLHLRLLFSKVSNFNVVQSTWVQCSYENSQKSGFFSSISTSITGNVEREKKPTVVVDSSVYPTGPPMSVQTQKLLKFVDLSQLCRGPVDSPGHWLVTGARLELERGKICLNVKFSLLNMC

SEQ ID NO: 477 - protein, 608 aa, Waldsteinia ternata
MALPAYRMDPQAAAEKAVAAIGSGYDLCLDLRLTSCKSGLVDLDPTRTRDLVLPGGAVVSDVSTSIKCDKGERTKFRSDVVSFNQMSEQYNKELSLSGKIPSGLFNAMFNYSGCWQKDAAPTKYLAFDGWLITLYSIELARSQLRLSEQVKRDVPSLWDPAALAAFIEKYGTHIIVGVKMGGKDIVHIKQLQNSKLEPAELQRRLKQVAEERFSDDANETSASNPTADLFGMMKDDNPLHWDIQRTLASSIKPPIVTHSMDDDVVTISVRRGGVDIGQSHNQWLSTISQAPNVISMSFVPITSLLGGTQGNGFLIHAVNLYLRYKPPIEELQQFLEFQLPRQWAPVYADLPLGLKRRRHASPSLQFSFMGPKLYVNTVKVDSVNRPVTGIRLYLEGKKGDHLAIHLQHLTSLPSSLQVSTDHSYEPIDEPEERGYFEPVKWSIFSHVCTAPVQHNGGCINDSASIVTKAWFEVKTMGMRKVLFLRLGFSAVASARLRRSEWEGSSSSRKSGFISTLISTRFSSALNPPVAPAKVDLNSAVYPGGPPLPSKAPKMATFVDTMERLRGPEDTPGYWVVTGAKLCVEGGRISVRVKYSLLTIMSEDSMMFL

SEQ ID NO: 478 - protein, 618 aa, Tupidanthus calyptratus
MEEEGGKPIEVIAMESLGLGFDFASDFKLKFAKRCPDGAGDDGRLVVIDEANKRDVVFPGGGVIRGVPESIRCGKGDRIRFKSDVLKFNQMSELINQKSSVQGKVPSGYFNAMFDLSGSWFNDAADSNHLAFDGYFISLYYLHLIASPLVLRDKVKNSVPSHWNPASLSRFIQTYGTHVIVGLAVGGRDLICVKQRQSSGIPPAELRGYLEDLGDCLFSDGKSPLLERKARDGKQNVPEVFTRMLQSNTKHFTSITETSSKDGLTIILSKRGGDVFSQNHSNWLQTVASNPEAICFKLVPITSLLTGVPGSGYLSHAINLYLRYKPIPEDLQYFLEFQVPRQWAPLFCEMPLGHQRRKASCPLLQFAFLGPKIHVSSTQVTSGEKPVVGLRLFLEGKKCNHLAIHVQHLSSLPNIMAFACANSTISKPSQWRGSDDYESSDQFLEPVRWKRYSNVCSSVVKHDPNWIQGEEPGGAFIVTGAQLISKGKWPKTVLHLYLLFTYLPNCTIRKTEWAAAPETSRRSGFLTNLSTTFTFTQRDVADAPKQLPAALNSAIYPDGPPVPLSSGKLLKYVDVSEVVRGPHDTPGHWLVTAAKLVTDGGKIGLHVKFALLDYLPEP

SEQ ID NO: 479 - protein, 371 aa, Tupidanthus calyptratus
MEEEGGKPIEVIAMESLGLGFDFASDFKLKFAKRCPDGAGDDGRLVVIDEANKRDVVFPGGGVIRGVPESIRCGKGDRIRFKSDVLKFNQMSELINQKSSVQGKVPSGYFNAMFDLSGSWFNDAADSNHLAFDGYFITLYCLHLTASPLVLRDKVKKSVPSHWNPASLSRFILTYGTHIIVGLAVGGQDVICVKQRPSSGIPPAELRGYLEDLGDCMFSDGRNPVLERKTRDGKQKVPEVFNRMLQSHTMQFSSITETSSKDGLTILSSKRGGDVFSQNHSNWLQTVASNPEAICFKLVPITSLLTGVPGSGYLSHAINLYLRYKPAPEDLRYFLEFQVPVQWAPLFCELPLRHQRRKASCPLLQFAFLGP

SEQ ID NO: 480 - protein, 390 aa, Platycerium bifurcatum
MASKLDIPNAAKVAHLAIQSLGRGYDLTCDLRFSSFKDRNGTSLIQLRNDETIKLSLPGGVIVADVPAIVKCDKGERTRFQSDILSFDQMCQQFNQGLSLSGKVPCGLFNNMFNFSGSWQKDASTTKHLALDGWFYTLYTVEMPRSKLVLKENIKSLVPTSWEPAALARFIETFGTHIIVGVKIGGKDVVYMRQHQSSPSTPIEFQKLLTEVSNERFLQTEGRASMGSKDSRSHKKRNIEFQSWSAHLDTFSQMIYNEKHHITIIPRRKGGFDHGQSHSEWIHTVPLTPDVISVSLIPITFLLHGVAGSGFLSHAVNLYLRYNPPIEELRQFLEFQLPRVWAPVYGELPLTLPRREPSLPTLQFSLMGPKLKVSKLEICASFFTKVEDGH

SEQ ID NO: 481 - protein, 630 aa, Platycerium bifurcatum
MASAKEAAALAAVEALGCGFDLTSDYRLKYKKGSLLELQHSHNKDLTIPGCITIPDVSRGIKCDKGEHMRFTSEVMQFQQMSQWFNQNASVEGKIPLGLFNAMFDLSGSWQDDANRLKNLAFDGCFITLYKLHLTRSNLVLREEVKNDIPSVWDPKSLAKFIEKYGTHIIVSASVGGQDVLYLKENYSSLISAQEIRKKLKSAGDEYFSETSGKRNADFKHSETSPLNSQPFRGTIAKSAGDEYFSETSGKRNADFKHSETSPLNSQPFRGTIAGSAQLLISNKDYTLISQRRGGYYFAKTHCEWQETVNMYPEAISLSFIPITSLLLGAVGSGFLQHAINLYLRYKPPVSDLQYFLDFQVPRQWIPVHNELPLRLARKQAFSPSLQFSLMSPKLYIDNNEVVVSRKPVTGIRLYLEGRKNNRLAIHLQHLSVLPQSLGKFWSEGIQIEAPLWNGSSDAPNEWFEPVEWKCFSHVCTQPIKYKPEWSNEQGSAFVVTGAQLGVKAHGLKSVLHLHLLFSKIPGCSIQRSRWDQHPAAEKTGFFSSISTTFSTTTKAGKKGPPVVVDSAVYMGGPPRPIQSPKLLKFVDTAELTKGPQDAPGHWVVTAARLELDRGKIAIKVKFSLLNYAE

SEQ ID NO: 482 - protein, 602 aa, Equisetum
MDQTRAKESIQALGCGYDVLDDLRLNRYKGDSKYRLIELDESQTQDLVIQGGITIPGVPKAITCEKGERTRFRTDVLPFQQMSEQVNQWMSIPGKIPLGLFNGMFGLSGHWQKDALSVKNLAIDGWLITFYSVELPKSQLVLREEVKKEVPSSWDPQGLASFIEKYGTHIIIGVKIGGKDVLCMKQHQSSSLSTIEIQALLKKKADERFANTEYGDDALSTEQKFDGEKNSAMNQSNQFQLYTATTVLYSSQDNATILCSRRGGNDVGQSHNQWLQTVPGSPDVVLMSFVPITSLLNGVAGSGFLSHAINLYLRHKPPIEELMHFLEFQLPRQWAPAFSDLPLGPPKKGQSTSLLRFSLIGPRLYVNTTPVSVGRRPVTGLRLYLEGRRCNRLAIHVQHVSSVPRVLQPFWEDHPFAGEPKWQGPEDPDERYSEPVFWRSFSHVCTAPVENADVWGGDSASGAHVVVGARLVVKKWGALRNVLYLDLLYSKIPQAKIRRSEWDHTPAASQKSGFFSTLMSGNFSNVLMPPPTKPPPLNLNSGIYPEGPPVPVRRPKLLKFVDTTEYTKGPQDMPGHWLVTGAKLYLDRGKISLRVKYSLLIC

SEQ ID NO: 483 - protein, 664 aa, Tupidanthus calyptratus
MAFNANRFDPQSAAEKAVSAIGSGYDLTVDIRLSECKPGPSGSGLIELDRTLTKDLNLPCGRVVRNVSPSIKCGKGEQTRFHSDVLTFVQMSEQFNQDISLSGKIPSGLFNAMFDFKGCWQKDAATTKSLAFDGWFFSMYNIELARSQITLSEQVKKEVPSSWDPAALAEFIEKYGTHIVVGVKMGGKDVIHLKQLQNSNLQPTEVQKLLKQLADERFSEDVNGSLIPNPEKSSGKQKEEPSIVQDLNLPFANLLRQAVVSQSKNDDLLSIRIRRGGFDTGQSHKQWLSTVSQFPNAISMSFVPLASLLSGIRGSGFLSHAINLYLRYKPPMEELEQFLEFQVPRQWAPVYGDLPLAPRRKKQASPSLKFTFMGPRLYVNTIRVDSENRPVTGIRLYLEGKKSDHLAIHLQHLSTLPKILQLSEDLSYEPIDEPAEKGYLEAVKWSIFLEGKKSDHLAIHLQHLSTPPKRLQLSDDLSYEPIDEPAEKGYLEAVKWSMFSHICTQPVQYNGARIDDSASIVTKAWFEVKGIGMKKVLFLRLGFSTVASAVIRRSEWDGPTMSTRKSGLMSMLISTRFSTGLTEKPELRKKLDLNSAIYPEGPPLPTRAPKMLSFVDTKETVRGPEVPPGYWVVTGAKLCVEGGRIRVKVKYSLLTIMSEDSLFI

SEQ ID NO: 484 - protein, 638 aa, Asplenium australasicum
MASTVGGLAAMQAQSSEAAQPPNMSFTAFSIAQQAVDALGRGYNVNLDLSLSYCKQGKRLIEIDESGPTQDLLLPGNIIIPNMPASIKCDKGDRTRFTTEVLKFNEMSEQFNQNLSISGKIPTGHFNTMFNFSGSWQKDASQVKTLALDGFFINLYTVELPRAQLTLKEEVRAAVPSSWDPAALASFVEKYGTHVIVGVKIGGKDVVCLKQHHTSQLSTIRVQKILEEKAKERFTPIAGGTSKEKINKGKIRDGSPYGSNAMNGSKDGLSLSWMNDSLSDLLTVETDDVRVMFKRKGGKDVSQSHEEWLHTVPAAPDIVSMSFVPITSLLSGVMGTGFLSHAINHFLRYKPSIAELHHFLEFQLPKEWAPAFGDLPLGPPRKQQASPSLQFRLMGPKLQVNTMPVVVGKRCVTGIRLHLEGKKSNRLAIHLQYLTAVPQILQGLWEDHRPDNWEGPDTDFSRYFEPVMWRSFSHVCTAPVESKEPWVDEMKGEPVLKGALVVTGAQLDVQQHGSKKVLFLRLLYSKIRKVRIRRSEWDHTPASQQRSGIFSTLISTHFSSAPSPLSKPVQVNSAIYPDGPPLANSQAPKLLKFVDTSEMTRGPLDLPGHWLVTGAKLCVERGKIAVRAKYSLLLYGAD

SEQ ID NO: 485 - protein, 606 aa, Rumohra adiantiformis
MASKLANAAKVANNAIQSLGQGFDLTCDLRFSTCKDVDGKSLIELRNNETFELSLPGGVVVANVPAIVKCDKGGRTRFRSDILSFDQMSQQFNQGLSLSGKIPCGLFNYMFNFTGSWQKDASTTRYLALDGWFYTLYTVEMPRSQLVLKEDIKASVPTSWEPAALARFIETFGTHIIVGVKIGGKDVVYMKQHQSTPSTSVDFQKLLAEVSDERFLQTEGRASVGSKDSRGNKKRSIEFQSLSDHLATFSQIIYNEKHHVTIIPRRKGGFDHGQSHSEWIQTVPLAPDVISMSLIPITFLLNGVAGSGFLSHAINLYLRYKPPIEELRQFLEFQFPREWAPVFSELPLTLSRREHSPSTLQFTLMGPKLKVSKLQVTIGKKPVTGMRLFLEGKRCDKLAIHLQHLSAIPRFLQALWEDHPFAREFTWQDPDDYSTKYFEPVQWKNFSHVCTAPVENTETWIGDHAGASVVVGAQLAVKSFGLRNVLYLRLLYSKIPEAKIRRSEWDHMPACTQKSGMFSSFLSSTFSATPAPTKVSAVVINSGIYPEGPPRPVRGPKLSKFVDTTEMTKGPQDMPGHWLVTGAKLYLDKRKISLRVKYSLLTVVAD

SEQ ID NO: 486 - protein, 253 aa, Doellingeria umbellata
MSDKLVQKAIDSLGKGFDLTSDFRLKYCKGNERLIVLNDYESELLVPGFGSFKGVSPDIKCDKGDRVRFQSDILDFNQMSEFFNKKCSVPGKIPNGFFNAMFGLQSGSWASDVANTKYLGLDGYFIVLFNVHLDRYPLILSDEVRNAVPSTWDPPALARFIEKYGTHIIVGMSIGGQDVILMKQSKSSHLEPSQLKKHLEDLGDQLFNGSCTFSPHQLKTKTPSAFSTMFDPDPMTFNGFSSTTPKDVGLIIM

SEQ ID NO: 487 - protein, 376 aa, Symphoricarpos x chenaultii (Hancock)
MGSSKETAKRLKALAEVAIESIGLGYDVAEDLRIKYCKDKSTRLITIDDDQVRDIVIPGGILIPNVSKSIKCDKGERMRFSSDVLSFQQMSEQFNQEVSLSGKIPTGHFNAAFEFTGSWQKDAANTKALAFDGVFITIYSIALEKTQIALCDHIKQAVPSSWDPPALARFIEKFGTHVVVGVKMGGKDSIYVKQQHSSPLQPDEVQKRLKDVADKRFSDAGGQNNTNDRFGNNELGLTFMDSTTSSSYLHKEDITLFWRRRGGSTSKNLDHNKWCQSVQLEPDVISMSFIPISSLLSGVHGSGFLSHAINLYLRYKPPIEELHQFLEFQLPRQWAPVFGELAVGPERKQQNGASLQFSFMGPKLYVNSNLVILLCC

SEQ ID NO: 488 - protein, 610 aa, Asplenium antiquum (makino)
MASKHDIPNAARVANLAFQSLGRGFDLTCDLRFSSCKDVHGAPLIELSDKDLRKVSLPGGVVVPNVPTIVKCDKGEQTHFRSDILTFDQMSQEFNHGLSLSGKVPSGFFNYMFNFTGSWQKDASATRHLALDGWFYTLYTLEMPRSQLVLKEDIKAAIPTSWEPAALARFIETFGTHIIIGAKIGGKDVVYLKQHQVSTSTLADFQKLLAEVSEERFSQTEGRASVGSKDSHSNNKRSMQFKSWTAPLDSFSQIIYNDKHHVTIIPRRKGGFDHGQSHSDWVHTVPLAPDVISVSLVPITSLLNGVPGSGFLSHAVNLYLRYKPPTEELRQFLEFQLPREWAPVFSELPLTLCRREQSPSTLQFTLMGPKLKVNKSQVTIGRRPVTGMRLFLEGKRCDRLSIHLQHLSAMPNFLTSFWEDHPFAREATWQDPDDYSTKYFEPLQWKNFSHICTAPVENTETWIGDHAGASVVVGAQLAVKSYKLRNVLYLRLLYSKIPEAKIRRSEWDHVPALAQKSGMFSSFFSTTFSSTAVTGAAKAPAVVINSGVYPEGPPKPVQDPKLLKFVDTTEMTKGPQDMPGHWLVTGAKLYLDRRKISLRVKYSLLTVSLD

SEQ ID NO: 489 - protein, 640 aa, Asplenium antiquum (Crissie)
MASAVAGLAAMQAQSSEAAQPPKMSSTAFSIAQQAVDALGRGYNVNFDLSLSYCKQGKRLIDIDESGPTQDLLLPGNIIIPNMPASIKCDKGDRTRFTTEVLKFNEMSEQFNQNLSILGKIPTGHFNTMFDFSGSWQKDASQVKTLAMDGFFINLYTVELPRAQLSLKEEVRAAVPSSWDPAALASFVKKYGTHVIVGVKIGGKDMVCLKQQRTSQLSTVRVQKILEEKAKERFTSIAGGTSKENNKGKIRDGFSYGSNAMNAVNGSKDGLPLSWMNNSLSDLLTVETADVRVMFKRKGGKAVSQSHEEWLHTVPAAPDIVSMSFVPITSLLNGVMGTGFLSHAINHFLRYKPSIAELHHFLEFQLPKEWAPAFGDLPLGPPRKQQASPSLQFRLMGPKLQVNTMPVVVGKSCVTGIRLHLEGKKSNRLAIHLQYLTVVPQILQSRWEDDQLEDWEGPDTDFSKYFEPVMWRSFSHVCTAPVESKEPWVDEMKGEPALKGALVVTGAQLDVEQHGSKKVLFLRLLYSKIHKVRIRRSEWDHTPASQQRSGIFSTLISTHFSSAPSSPSKPVQVNSAIYPDGPPLANSQAPKLLKFVDTSAMTRGPLDLPGHWLVTGAKLDVERGKIAVRAKYSLLLYGAD

SEQ ID NO: 490 - protein, 493 aa, Aglaomorpha (Roberts)
MASKLDIPNAATVAHLAIQSLGRGYDLTCDLRFSSFKDVNGASLIELRDSETIELSLPGGVVVANVPAIVKCDKGERTRFRSDILAFEQMSQQFNQGLSLSGKIPCGLFNNMFNFTGSWQKNSSNTKHLALDGWFYTLYNMEMPRSQLVLKEDIKASVPSSWEPVALARFIETFGTHIVVGVKVGGKDVVYMKQHQSSPSTSIEFQKLLAEVSDERFLRSEGRASVGSKDSRSNKKHNIEFQPWSAHLDTFSQMSYNEKHHVTIIPRRKGGFDHGQSHSEWIHTVPLAPDIISVSLIPITFLLHGVAGSGFLSHASNLYLRYKPPIEELRQFLEFQLPREWAPVYSELPLTLPRREPSLSTLQFTFMGPKLKVSKLEVAVGKKPVTGMRLFLEGKRCDKLAIHLQHLSAIPRFLQPLWEDHPFSREVTWQDPDDYSTKYFEPVQWKNFSHVCTAPVENTETWIGDHAGASVVVGAQLGVKSFGLRNVLYLRLL

SEQ ID NO: 491 - protein, 665 aa, Vernonia noveboracensis
MALKLPAAEAANVAIQSIGCGYDISLDLRLKYRKGEFISDVGNNQNRNCRLIEIDEDEGRDIVLPGGLLIPNVSKSIKCDKNQRTRFRSDVLSFQQMSEQFNQEISLTGKIPSGLFNAMFEYSGSWQKDASSTKTRFRSDVLSFQQMSEQFNQEISLTGKIPSGLFNAMFEYSGSWQKDASSTKTLAFDGVFISLYTVALEKSQMVLCDNVKKAVPSSWDPALLARFIEKFGTHIIVGVKMGGKDVIYMKQQHASSLQPADVQKRLKAMADKRFLDADGQYIIDAEHTSHNDKDDIRGQRLRFADADPSSSYSYKEDLVSIYKRRGGCDDRNLKHNEWLHGVQLEPDVITMSFIPITSLLNGVSGSGYLSHAINLYLRYKPPVEELHQFLEFQLPRQWAPVFSDLPLGPQRKQQTTPSLQFSFFGPKLYVNINPVDVGKRPVTGLRLYLEGKRSNRLAIHLQHLSSLPKVFQLEDDVDGNLAEESYDRRYYEKVQWKHFSHVCTAPVESDDELSIVTGAHLHVGDYGFKRILFLRLRFSTVVGAAAIKNPEWDGSPGLARKSGLISTLISHHFTAVLKSQPQAAEVNINSAIYPGGPPAPVQVPKLLKFVDTAEMTRGPQESPGYWVVSGARLVVDKGKISLRVKYSLLTVISADEEEEAAAAFY

SEQ ID NO: 492 - protein, 328 aa, Tupidanthus calyptratus
MAFNANRFDPQSAAEKAVSAIGSGYDLTVDIRLSECKPGPSGSGLIELDRTLTKDLNLPCGRVVRNVSPSIKCGKGEQTRFHSDVLTFVQMSEQFNQDISLSGKIPSGLFNAMFDFKGCWQKDAATTKSLAFDGWFFSMYNIELARSQITLSEQVKKEVPSSWDPAALAEFIEKYGTHIVVGVKMGGKDVIHLKQLQNSNLQPTEVQKLLKQLADERFSEDVNGSLIPNPEKSSGKQKEEPSIVQDLNLPFANLLRQAVVSQSKNDDLLSIRIRRGGFDTGQSHKQWLSTVSQFPNAISMSFVPLASLLSGIRGSGFLSHAINLYLRC

SEQ ID NO: 493 - protein, 340 aa, Tupidanthus calyptratus
MEEEGGKPIEVIAMESLGLGFDFASDFKLKFAKRCPDGAGDDGRLVVIDEANKRDVVFPGGGVIRGVPESIRCGKGDRIRFKSDVLKFNQMSELINQKSSVQGKVPSGYFNAMFDLSGSWFNDAADSNHLAFDGYFISLYYLHLIASPLVLRDKVKNSVPSHWNPASLSRFILTYGTHIIVGLAVGGQDVICVKQRPSSGIPPAELRGYLEDLGDCMFSDGRNPVLERKTRDGKQKVPEVFNRMLQSHTMQFSSITETSSKDGLTILSSKRGGDVFSQNHSNWLQTVASNPEAICFKLVPITSLLTGVPGSGYLSHAINLYLRYKPAPEDLRYFLEFQVP

SEQ ID NO: 494 - protein, 621 aa, Nephrolepis cordifolia (Duffii)
MASTKEAAALAAVKALGCGFDLTSDYRLKYKKGPLLHLQHSYTKDLTIPGGITIPDVVRDVKCDKGERIRFASEIMQFQQMSQFFNQNSSIEGKIPLGLFNAMFDLSGSWQDDANRIKNLAFDGCFITLYKLHLTRSNLVLQEEVKNDIPSVWDPQRLAKFIEKYGTHIIVSASIGGQDVLYLKENSSSLLSAQDLHKKLKSAGEEYFSDKGAKGNTSFKDSETSPLNALHSHQFRALAPSAQLFISNKDYTIISQRRGGYFFAKNHCEWQETVNSYPEAIQRRGGYFFAKNHCEWQETVNSYPEAISLSFVPITSLLLGIAGSGFLQHAINLYLRYKPPVSDLQYFLDFQVPRQWIPIHNELPLRLARKQVFSPSLQFSLTSPKLYVNNNEVVVNRKPVTGVRLYLEGRKSNKLAIHLQHLSVLPQSLGQFWSESTQMELPRWNGSNDAPNDWFEPVEWKCFSHVCTQPIKYKPEWLNERGGAFVVTGARLDVKAHGLKSILHLHLLFSKIPGCTIQRSRWNEHPAAEKAGFFSSISTTFSATTKTGKKGPPVVVDSAIFMEGPPRPIQSPKLLKFVDTTELTKGPQDAPGHWVITAARLELEKSKISLRAKFSLLNYTE

SEQ ID NO: 495 - protein, 629 aa, Pteris cretica (roweri)
MHPQSSEVATSQPHSRAFLVAQQAVDALGRGYDVTCDLWLSYCKNGELLIENDESSPTQDLFLPGNIAIPRVSTAVKCDKGDRTRFTTDVLTFNEMSEQFNQSLAISGKIPLGHFNGMFNLSGSWQRDASMVKTMAMDGVYINLYSVELSRTKLALKEEVKAAVPSSWDPAALASFVEKYGTHVIVGVKIGGKDVICIKQRSSSSLSAVGVQRILEAKSKERFSSIEGSMSKEKTDRGKIRDGSILGSNGINAAHKSGVPLPWIHDSSSDFSVETDEVTVTFKRKGGRDSSQSHDEWLQTVPSAPDIVSMSFVPITSLLNGITGTGFLSHAINLYLRYKPTIQELHHFLEFQLPKEWAPAYGDLPLGPPRKQQGSPSLQFRPLGPKLQVNTTPVVVGKRCVTGIRLHLEGKKGNRLAVHLQYLTVVPQILQRTWEDDQPEIWEGPDTDFLKYFEPVMWKSFSHVCTAPVESSEMWDDETKGEQGGPRAALVVTGARLDVEQHGSKKVLFLRLLYSKIHGASIRRSEWDDAPASQQKSGIFSTLMSTTFSTAQASPLKPVQVVVNSAIYQGPPPANSQAPKLLKFVDTTEMTRGPVDSPGHWLVTGAKLFVGNGKIAVRPKYSLLLYSME

SEQ ID NO: 496 - protein, 607 aa, Phormium (Lancer Terra Cotta)
MALKFPPRKAAEFAINSIGLGYDVAADIRLKYCKRETQDPCLIELDKDQLQDIVLPGGITVSNVPKSIKCDKGERTRFRSDVLSFQQMSEQFNQELSLSGKIPSGLFNYMFEFSNCWQKDAANTKSLAFDGWFITLYTVALAKSQIVLRDHVKQAVPSSWDPAALARFIEKFGTHVIVGVKMGGKDVIYVKQQHFSNLQPAEVQKILKDMADKRFLDVSGQYGMNSEEAFGKDKFDFKEQRLRFADSSSSSSYSTKEDIVRIFKRRGGNDNKDLPHPEWLNTVQYEPDVISMSFVPITSLLQGIPGSGFLSHAINLYLRYKPPTEELHQFLEFQLPRQWAPVFSDLPLGPQRKHQSTASLQFTFMGPKLYVNTSVVDVGKRPVTGLRLYLEGKRSNRLAIHLQHLSSLPRIFELREDPSSSYSRESHDRKYYEPIQWRHFSHVCTAPIEADEDNSIVTGAQLHVGHYGLKKVLFLRLHFSTVSNVTLVRNHEWDGSPGLAHKSGLISTLISTRFTAAIQKPPPRPADVYINSAVYPGGPPVPVQTPKLLKFIDTTEMVRGPQNPPGYWVVSGAKLQLERGKISLRVKYSLLTVLLPDDDDDDDDDDV

SEQ ID NO: 497 - protein, 390 aa, Tupidanthus calyptratus
MSSSTSTSSSSSSSGDGIVWRAINSLGKGFDLTSDFRLKYCKGNHPLVLLNQTHTKQLLVPGFGYFNHVSSDINCGKGERTRYQSDILDFNQMSEFMNQRSSVPGKIPSGLFNSMFGFESESWAKEAASTKCLGLDAYFISLFHLRINRYPLVLCDEVRNAVPSTWDPSALARFIEKYGTHIIVSLGIGGQDTVVVRQDKSSNLEASDLKKYLDQLGDQLFTGTCTFTPKQRNHKAPAAFNVFDHQSTLFDNFSSVKTKNGVNVICSKRGGDVSAHTHCEWLLTVPSMPDAIQFSFIPITSLLKGVPGNGFLTHAINLYLRYKPPLDDLQYFLDFQAYKIWGPVHSELTLGPATNRALGTPTLHFNLIGPKLYVNTTRVHTLNNSIPLNK

SEQ ID NO: 498 - protein, 664 aa, Asplenium australasicum
MASTVGGLAAMQAQSSEAAQPPNMSFTAFSIAQQAVDALGRGYNVNLDLSLSYCKQGKRLIEIDESGPTQDLLLPGNIIIPNMPASIKCDKGDRTRFTTEVLKFNEMSEQFNQNLSISGKIPTGHFNTMFNFSGSWQKDASQVKTLALDGFFINLYTVELPRAQLTLKEEVRAAVPTSWDPAALASFVKKYGTHVIVGVKIGGKDVVCLKQHHTSQLSTIRVQKILEEKAKERFTPIAGGTSKEKINKGKIRDGSPYGSNAMNGSKDGLSLSWMNDSLSDLLTVETDDVRVMFKRKGGKDVSQSHEEWLHTVPAAPDIVSMSFVPITSLLSGVMGTGFLSHAINHFLRYKPSIAELHHFLEFQLPKEWAPAYLRYKPPIDQLRHFLEFQLPKDWAPAFGDLPLGPPRKQQASPSLQFRLMGPKLQVNTMPVVVGKRCVTGIRLHLEGKKSNRLAIHLQYLTAVPQILQGLWEDHRPDNWEGPDTDFSRYFEPVMWRSFSHVCTAPVESKEPWVDEMKGEPVLKGALVVTGAQLDVQQHGSKKVLFLRLLYSKIRKVRIRRSEWDHTPASQQRSGIFSTLISTHFSSAPSPLSKPVQVNSAIYPDGPPLANSQAPKLLKFVDTSAMTRGPLDLPGHWLVTGAKLDVERGKIAVRAKYSLLLYGAD

SEQ ID NO: 499 - protein, 642 aa, Asplenium australasicum
MASTVGGLAAMQAQSSEAAQPPNMSFTAFSIAQQAVDALGRGYNVNLDLSLSYCKQGKRLIEIDESGPTQDLLLPGNIIIPNMPASIKCDKGDRTRFTTEVLKFNEMSEQFNQNLSISGKIPTGHFNTMFNFSGSWQKDASQVKTLALDGFFINLYTVELPRAQLTLKEEVRAAVPSSWDPAALASFVEKYGTHVIVGVKIGGKDVVCLKQHHTSQLSTIRVQKILEEKAKERFTPIAGGTSKEKINKGKIRDGSPYGSNAMNGSKDGLSLSWMNDSLSDLLTVETDDVRVMFKRKGGKDVSQSHEEWLHTVPAAPDIVSMSFVPITSLLSGVMGTGFLSHAINHFLRYKPSIAELHHFLEFQLPKEWAPAFGDLPLGPPRKQQASPSLQFRLMGPKLQVNTTPVVVGKRCVTGIRLHLEGKKSNRLAIHLQFLTVVPQILQSRWEDDQLEDWEGPDTDFSKYFEPVMWRSFSHVCTAPVESREPWAADEMAGEAALKGALVVTGAQLDVEQHGSKKVLFLRLLYSKIHKAMNRRSEWDHTPASSQRSGIFSTLISTPFSSAAASSPAAAKPVHVNSAIYPDGPPPANSQAPKLLKFVDTSEMTRGPLDLPGHWLVTGAKLCVERGKIAVRAKYSLLLYSED

SEQ ID NO: 500 - protein, 600 aa, Matteuccia struthiopteris
MASANDAVALAAVEALGCGFDLTSDYRLKYRKGPLLHLQHSYNKDLTIPGGITIPDVSRDVKCDKGERIRFASEVMQFQQMSQWFNQNASVEGKIPLGLFNAMFDLSGSWQDDANQLKNLAFDGYFITLYKLHLTRSHLVLREEVKNDIPSVWDPQSLAKFIEKYGTHIIVSASVGGQDVLYLKENYSSLLSTQDIHKKLKSAGDDYFSDRGGEKSANFKESETLPLNALSSQPFRATVAHIHSAQVLVTNKDFTIISQRRGGYHFAKTHCGWQETVNIFPEAISLSFVPITSLLVGVAGSGFLQHAINLYLRYKPPVSDIQYFLDFQVPRQWIPIHNELPLRLARKQTFSPSLQFSLTGPKLYINNNEVVVNRKPVTGIRLYLEGRKSNRLAIHLQHLSVLPQSLGQFWNEGTELESPWWNGSNDAPKEWFEPVEWKCFSHVCTQPIKYKPEWLNERGSAFVVTGARLEVKAHGLKNVLHLHLLFSKIPGCTIQRSRWGQHPAAEKTGFFSSISTTFSSTTKAGKKGPPVVVDSAVFIGGPPRPIQSPKLLKFVDTTELTKGPQDAPGHWVVTAARLELDRGKISVSVKFSLLNYADAE

SEQ ID NO: 501 - protein, 603 aa, Platycerium bifurcatum
MASKLDIPNAAKVAHLAIQSLGRGYDLTCDLRFSSFKDRNGTSLIQLRNDETIKLSLPGGVIVADVPAIVKCDKGERTRFQSDILSFDQMCQQFNQGLSLSGKVPCGLFNNMFNFSGSWQKDASTTKHLALDGWFYTLYTVEMPRSKLVLKENIKSLVPTSWEPAALARFIETFGTHIIVGVKIGGKDVVYMRQHQSSPSTPIEFQKLLTEVSNERFLQTEGRASMGSKDSRSHKKRNIEFQSWSAHLDTFSQMIYNEKHHITIIPRRKGGFDHGQSHSEWIHTVPLTPDVISVSLIPITFLLHGVAGSGFLSHAVNLYLRYNPPIEELRQFLEFQLPRVWAPVYGELPLTLPRREPSLPTLQFSLMGPKLKVAVGKKPVTGLRLFLEGKRCNKLAIHLQHLSAIPKFLQPLWENHPFAREVTWQDPDDYSTKYFEPVQWKNFSHVCTAPVENTETWIGDHAGASVVVGAQLAVKSFGLRNVLYLRLLYSKIPEAKIRRSEWDHMPALTQKSGMFSSFLSTTFSSTPAPPKVPAVVINSGIYSEGPPNPVRDPKLLKFVDTTEMTKGPQDMPGHWLVTGAKLYLDKRKISLRVKYSLLTVNSD

SEQ ID NO: 502 - protein, 527 aa, Waldsteinia ternata
MRFGSDVLSFQQMSEQFNQELALSGKIPSGHFNTAFEFTGGWQKDAANTKTLAFDGVSITLYSVALEKSQVSLREQVKQDVPSSWDPTALARFISKYGTHVIVGVKMGGKDTIYAKQMYSSPVQPADVQKKLKDMADKMYVDGNSHSGVTSEKFHERDKFIKEQGLGIMNAIPSSSYASVESQDIKFVCKRKGGSLHKNLRHSEWSQTVQLEPDVISMSFVPITSLLSGIHGSGFLTHAINLYLRYKPPVEELHQFLDFQVPRQWAPVFGELALGPQRRQESTASLQFSFMGPKLYVNTNPVDASKKPVTGLRLYLEGKRSNCLAIHLQHLSSLPKTFQLQDQVKISHPSSDRRYYERVQWKSFSHVCTAPIEAGDDFSVVTGAQFQIGESGMKKVLFLQLHFSKVSNAINVRQAEWDGSPALTQKSGIMSTIISTRFSTAQKQPPNPANVDINSALYPGGPPVATQAPKLLRFVDTTEMTRGPQDSPGYWVVSGARLMVEKAKISLRVKYSLLTMILPDEEEMGDG

SEQ ID NO: 503 - protein, 618 aa, Tupidanthus calyptratus
MEEEGGKPIEVIAMESLGLGFDFASDFKLKFAKRCPDGAGDDGRLVVIDEANKRDVVFPGGGVIRGVPESIRCGKGDRIRFKSDVLKFNQMSELINQKSSVQGKVPSGYFNAMFDLSGSWFNDAADSNHLAFDGYFITLYCLHLTASPLVLRDKVKKSVPSHWNPASLSRFIQTYGTHVIVGLAVGGRDLICVKQRQSSGIPPAELRGYLEDLGDCLFSDGKSPLLERKARDGKQNVPEVFTRMLQSNTKHFTSITETSSKDGLTIILSKRGGDVFSQSHSKWLQTVASNPEAISFKLVPITSLLTGVRGSGYLSHAINLYLRYKPIPEDLQYFLEFQVPRQWAPLFCEMPLGHQRRKASCPPLQFSFMGPKTRISSTLVTSGQKPVVGLRLFLEGKKCNHLAIHVQHLSSLPNIMAFACANSTISKPSQWRGSDDYESSDQFLEPVRWKRYSNVCSSVVKHDPNWIQGEEPGGAFIVTGAQLISKGKWPKTVLHLYLLFTYLPNCTIRKTEWAAAPETSRRSGFLTNLSTTFTFTQRDVADAPKQLPAALNSAIYPDGPPVPLSSGKLLKYVDVSEVVRGPHDTPGHWLVTAAKLVTDGGKIGLHVKFALLDYLPGS

SEQ ID NO: 504 - protein, 347 aa, Vernonia noveboracensis
MSFYQTNFYDPQSAAEKAVSVIGYGYDLTSDIRLTGCKPGPTGSTLIELDRTLSKDLVVPGGVVVHDVSPAIKCDKGERTRFHSDVLSFNHMSEQFNQEVSLSGKIPSGFFNSMFGYKGCWQKDAATTKNLAFDGWFITLYNIELEKAQIVLSEKVKQQVPSLWDPTALAEFIDKYGTHIVVGVKMGGKDVIYLKQLHSSNLEPTEVQNLLKQLADDEWSEDVSASSVSGPDKLIKQKDARSVAWDIPVLGNSIRQPIVISRSKKDDLLSIHVRQGGIDHGQSHKSWLSTVSQSPNVISMSFVPIVALLGGVRGSGFLSHAINLYLRCEFADFLYGSEKCKVYSLKK

SEQ ID NO: 505 - protein, 291 aa, Tupidanthus calyptratus
MAFNANRFDPQSAAEKAVSAIGSGYDLTVDIRLSECKPGPSGSGLIELDRTLTKDLNLPCGRVVRNVSPSIKCGKGEQTRFHSDVLTFVQMSEQFNQDISLSGKIPSGLFNAMFDFKGCWQKDAATTKSLAFDGWFFSMYNIELARSQITLSEQVKKEVPSSWDPAALAEFIEKYGTHIVVGVKMGGKDVIHLKQLQNSNLQPTEVQKLLKQLADERFSEDVNGSLIPNPEKSSGKQKEEPSIVQDLNLPFANLLRQAVVSQSYQTLKNHLENRRRNHLLSRISICHLQTC

SEQ ID NO: 506 - protein, 601 aa, Tupidanthus calyptratus
MALKLPAPEAAKIAIQSIGCGYDICLDLRLKYRKRDSTNLSLIEIHEDQEKEIVLPGGILIPNVSKAIKCDKGEHARFRSDVLSFQQMSEQFNQEMSLTGKIPSGVFNTMFEFTGSWQKDAAHTKTLAFDGLFITLYTVALDKSQMVLSDHVKKAVPSSWDPAALARFIEKFGTHIIVGVKMGGKDVIYMKQQHSSSLQPSDVQKRLKTIADKRFVDARGQSGMDSEQTYQKDKFQVREQRLRFADTSLSSSYSYKEDIVSICMRRGGNDNKNLTHNEWLHNVQLEPDVISMSFIPITSLLNGVSGSGFLSHAINLYLRYKPPTEELHQFLAFQLPLHWAPVFSVHPLGLQPRQQSTASLQFSFMGPKLHVNTSPVDVGKRPVTGLRLYLEGKKSNRLAIHMQHLSSLPEFFQLEDDPNGNFRQESYDRRYYEKVQWKNFSHICTAPVESDEDLSIVTGAQLEVGDYGFKRVLFLRLRFSTVLGAVAVKHPEWDGSPGLARKSGLISTLISHHFTATLKPPPQPADVNINSAIYPGGPPAPTQSAKLLKFVDTTEMTRGPQETPGYWVVSGARLMVEKGRISLRVKYSLLTVMLPDEEALE

SEQ ID NO: 507 - protein, 312 aa, Tupidanthus calyptratus
MEEEGGKPIEVIAMESLGLGFDFASDFKLKFAKRCPDGAGDDGRLVVIDEANKRDVVFPGGGVIRGVPESIRCGKGDRIRFKSDVLKFNQMSELINQKSSVQGKVPSGYFNAMFDLSGSWFNDAADSNHLAFDGYFITLYCLHLTASPLVLRDKVKKSVPSHWNPASLSRFILTYGTHIIVGLAVGGQDVICVKQRPSSGIPPAELRGYLEDLGDCMFSDGRNPVLERKTRDGKQKVPEVFNRMLQSHTMQFSSITETSSKDGLTILSSKRGGDVFSQNHSNWLQTVASNPEAICFKLVPITSLLTGVPVKS

SEQ ID NO: 508 - protein, 640 aa, Lygodium flexuosum
MKPAAVTLRPNFYTSSSSSAPSDPASVAKQAVDALGRGYDVTGDLWLSKCREPLIVDLAESSPTQDLAIPGGISLPSVPAPIKCDKGDRTRFASDILSFSEMSEQFNKTLSIAGKIPLGLFNSMFGFTGLWQKDASSTKTLALDGVFINLYSVEVPRTHLNLREEVRKAVPSSWDPAALASFVDKYGTHVIVGVKIGGKDVIYVKQRHSSPLSAVSIQKILETKAVERFSSGETCTSKEKLTKGKDFQTKGIHGAEPNGQNGNLLRGHVDGMENSESFSLMEDSSTFSIDGDVTVIYKRKGGSESCQSHNDWLHTVPLAPDVVSMSFVPITTLLNGVPGTGFLSHAINLYLRYKPPLQELSNFLEFQLPKEWAPAFGDLPLGPPRKQQEVPSLQFRLMGPKLHINTTPVVVGKRPVTGLRLYLEGKKSNKLAIHLQYLTAVPQILKTLWVEDGGGEEEWVGPEEDFSKYFEPVQWRNFSHVCTAPVENSETWLGGPGGALVVVGARLQVQQYGAKKVLFLHLLYSRIAKARIRRSEWDHMPASQQKSGLFSTLISTTFSSAAAQSPAPPKPVVINSAIYPEGPPVPGQMPKLLKFVDTTEMTRGPHDLPGHWLVTGAKLLLERGKISLRAKYSLLLYSVE

SEQ ID NO: 509 - protein, 331 aa, Tupidanthus calyptratus
MAFNANRFDPQSAAEKAVSAIGSGYDLTVDIRLSECKPGPSGSGLIELDRTLTKDLNLPCGRVVRNVSPSIKCGKGEQTRFHSDVLTFVQMSEQFNQDISLSGKIPSGLFNAMFDFKGCWQKDAATTKSLAFDGWFFSMYNIELARSQITLSEQVKKEVPSSWDPAALAEFIEKYGTHIVVGVKMGGKDVIHLKQLQNSNLQPTEVQKLLKQLADERFSEDVNGSLIPNPEKSSGKQKEEPSIVQDLNLPFANLLRQAVVSQSKNDDLLSIRIRRGGFDTGQSHKQWLSTVSQFPNAISMSFVPLASLSGFQLSHSFLMPYQCPLCLLLHF

SEQ ID NO: 510 - protein, 536 aa, Tupidanthus calyptratus
MYPNKLIVIKVSGYDLAHGLSFQQMSEQFNQEVSLSSKIPTGHFNAAFQFTGCWQKDAANTKTLALDGVFITIYTIALEKSQITLCDHIKEAVPSSWDPAALARFIEKFGTHVIVGVKMGGKDIVYMKQQHSSPLQSDEVQKRLKHVADNRFSNASGHSTNPEKVYEREMLEINEPPQEFMDDSASSSYMDLEDITFFYRRRGGSNKKNLPHDKWCQSVQLEPDVISMSFIPISSLLSGINGNGFLTHAINLYLRYKPAIEELSQFLEFQHPRQWAPVFGELAVGPERKQQSGASLQFSFLGPKLYVNTTLVDAGKRPVTGLRLYLEGTKSNCLAIHLQHLSTLPKSFQLQDEATCNYGSNDQRYYEKVQSKSFSHVCTGPVESDEDHSIVTGAQFEVRNSGMKRVLFLRLHFSKVIGSTVFKQPEWDGSPIIAQKSGIISTLISSRFSANQKQPPRPSDFNINSAIYPSGPPVPAQATKLLRFVDTSEMTRGPQDRPGYWIVSGARLLVDRGKISLCVKYSLLAVILPEDEMSLQ

SEQ ID NO: 511 - protein, 381 aa, Doellingeria umbellata
MMEGIEVRALESLGLGFDIASDFRLKFAKRCPDGGGRLVEMDESSRDIVIPAAGASSVVVSGVSQDIRCDKGDRIRFKSDVLEFNKMSELLNQKSSIQGKVPSGYFNALFDLSGAWLNDISDAKYIAFDGYFISLYYLHLTTSPLVLQESVKKSVPTHWNPLLLARFIQTYGTHIIVGMAVGGQDIICVKQKPSSPIPPGELKRYMDDLGDSLFSDGRSPSLMERKTRDGKQKVPDVFTRMLQPHTVQFSNITETSSKDGLTVIECKRGGDVFSESHSKWLQTVGTNPEAMLFKFVPITSLLNGVPGSGYLSHAINLYLRYKPALEDLQCFLEFQVPRQWAPLFCELPLRHQRRKTSCPRLQFSFMGPKFYVSTTQWCYRN

SEQ ID NO: 512 - protein, 428 aa, Doellingeria umbellata
MMEGIEVRALESLGLGFDIASDFRLKFAKRCPDGGGRLVEMDESSRDIVIPAAGASSVVVSGVSQDIRCDKGDRIRFKSDVLEFNKMSELLNQKSSIQGKVPSGYFNALFDLSGAWLNDISDAKYIAFDGYFISLYYLHLTTSPLVLQESVKKSVPTHWNPLLLARFIQTYGTHIIVGMAVGGQDIICVKQKPSSPIPPGELKRYMDDLGDSLFSDGRSPSLMERKTRDGKQKVPDVFTRMLQPHTVQFSNITETSSKDGLTVIECKRGGDVFSESHSKWLQTVGTNPEAMLFKFVPITSLLNGVPGSGYLSHAINLYLRYKPALEDLQCFLEFQVPRQWAPLFCELPLRHQRRKTSCPRLQFSFMGPKIYVSTTQVLSDDKPVIGLRLFLDGKKSNRLAMHVQHLSSLPDTITRTYSKSTVNRRPSQ

SEQ ID NO: 513 - protein, 286 aa, Sphaeropteris cooperi
MGSEAAARKVALDAVQSLGRGFDVTADFRTKFCKKRLVHIVNDGLESLTLPGDITIDAPSVIKCDKGECTRHTSDLMQFQQMSQAFNKRALIDGKIPLGHFNAMYDFTGSWFEDAMQTKNLAFDGKFITLFQLQLTSSLLLRKEVKNAVPSAWEPAALARFISLYGTHIVVRVSVGGQDVLYLKENASSMMSSADVHKHLKNLGDQMFAEKGVQKIQDGNSLRGCSIAPVEIDGTNILYKSKISLRLRTSDVSLSFKSLGSGRLCTVTCLLALHRGQSHCHLCNSV

SEQ ID NO: 514 - protein, 640 aa, Thelypteris noveboracensis
MASAVGGLVSMQAQSSEAAPLQNMSSLAFSVAQQAVDALGRGYDVNADLWLRYCKRGERLIENDNSGPTQDLLLPGNIIIPSVPTSIKCDKGDRTRFTSDVLTFSEMSEQFNQNLSIAGKIPVGHFNAMFGFSGSWQKDASQVKTLAMDGVFINLYSVELPRAQITLKEEVRAAVPSSWDPAALASFVEKYGTHVIVGVKIGGKDVICLKQHRSSSLSAVGVQKILETKAKERFSSVEGSAAKEKINKGKIRDGFTYESNGMNAVNGSKDGMPLPWTSDSSTDLETDDVTVIFKRKGGKDISHSHDEWLHTVPSAPDIVSMSFVPITSLLNGVTGTGFLSHAINHYLRYKPPIQELHHFLEFQLPKEWAPAFGDLPLGPPRKQQGSPSLQFRLMGPKLQVNTTPVVIGKRCVTGLRLHLEGKKSNRLAIHLQYLTVVPQILQRLWEDDQPEEWEGPDEDFGKYFEPVMWKSFSHVCTAPVESNEAWVDEAKGEPGPKGALVVTGAQLDVEQHGSKKVLFLRLLYSKIHKATIRRSEWDHTPASQQKSGIFSTLMSTPFSSAQAAPLKPAQVVINSAIYPQGPPPAKSQAPKLLKFVDTTEMTRGPLDLPGHWLVTGAKLFVDRGKIAVRAKYSLLLYSVD

SEQ ID NO: 515 - protein, 428 aa, Phormium (Lancer Terra Cotta)
MGGKDAVSIKQLQESALQQTEVQNLLKNLADDAFSEDFNANILLGAAEISKRLKGIKLANQENNAAVLKSMNSSIVTHLKKDDIVSIHVRRGGINTKQSHNQWLSTISQAPNVISMSFVPITSLLTGVRGSGFLSHAVNLYLRYKPPIEELHHFLEFQLPRQWAPVFNEIPLGPQHRKRRRLPSLQFTLMGPRLHVNTDKVDSKNRPVTGIRLFLEGKRNDCLAIHLQHLSTRPNIFQLSNDSDHTSADDISLNQRDYYEPIKWALLSHICTAPVQYSGASIDDSASIVTKAWLEVKDIGMRKVLFLRLGFSNVVGMKIRRSEWDGLTNVTRKSGSISAMISSRFSTGMIPPQKPKVEINSAVFPGGPPVPIRVPKMSRFVDTTEMMRGPDDLPGYWLVTGAKLCVEGGGISLKVKYSLLVPKPEDEL

SEQ ID NO: 516 - protein, 401 aa, Lygodium flexuosum
MENSESFSLMEDSSTFSIDGDVTVIYKRKGGSESCQSHNDWLHTVPLAPDVVSMSFVPITTLLNGVPGTGFLSHAINLYLRCKLMLAVHDFAFPVCVNFANSSFDQVSSLWATDKPPLQELSNFLEFQLPKEWAPAFGDLPLGPPRKQQEVPSLQFRLMGPKLHINTTPVVVGKRPVTGLRLYLEGKKSNKLAIHLQYLTAVPQILKTLWVEDGGGEEEWVGPEADFSKYLEPVQWRNFSHVCTAPVENSETWLGGPGGALVVVGARLQVQQYGAKKVLFLHLLYSRIAKARIRRSEWDHMPASQQKSGLFSTLISTTFSSAAAQSPAPPKPVVINSAIYPEGPPVPGQMPKLLKFVDTTEMTRGPHDLPGHWLVTGAKLLLERGKISLRAKYSLLLYSVE

SEQ ID NO: 517 - protein, 629 aa, Aglaomorpha (Roberts)
MASAKDAAALAAVEALGCGFDLTSDYRLKYKKGSLLELQRSHNKDLTIPGGITIPDVSRDIKCDKGERMRFASEVMQFQQMSQWFNQNASIEGKIPLGLFNAMFDLSGSWQDDASRLKSLAFDGSFITLYKLHLTRSNLVLREDVKKDIPSVWDPKSLAKFIEKYGTHIIVSASVGGQDVLYLKENDSSLLSAQDIRKKLKSAGDDYFSENSGKRNADFKDSDSSLLSAQDIRKKLKSAGDDYFSENSGKRNTDFKDSETLPLNSQPFRGTIAASAQLLISNKDYTVLSQRRGGYYFAKTHCEWQETVNMYPEAISLSFVPITSLVLGAAGSGFLQHAINLYLRYKPPVSDLQYFLDFQVPRQWIPVHNELPLRLARKQAFSPSLQFSLMSPKLYINNNEVVVNKKPVTGIRLYLEGRKNNRLGIHLQHLSVLPQSLGQFWSEGTQIESPQWNGSNDAPNDWFEPVEWRCFSHVCTQPIKFKSEWLNERDSAFVVTGARLDVKAHGLKSVLHLHLLFSKIPGCTIQRSRWDQHLAAEKTGFFSSISTTFSTTTKAGKKSPQVVVDSAVFMGGPPRPIQSPKLLKFVDTAELIKGPQDAPGHWVVTAARLELDRGKIAIKVKFSLLNYAE

SEQ ID NO: 518 - protein, 479 aa, Matteuccia struthiopteris
MGGFTHCIQWKCQSRSQLVLKEDILASVPTSWEPAALARFIETFGTHIIVGAKIGGKDVVYMKQHQSSPSTSIDFQKLLAEVSDERFLQTESRASVGSKDSRSNKKRSVEFQSWSAHLDTFSQIIYNEKHHVTIIPRRKGGFDHGQSHSEWIHTVPLDPDVISVSLVPITVLLNGVSGSGFLSHAVNLYLRYKPHIEELRQFLEFQLPREWAPVFSELPLTLSRREHSPSTLQFTLMGPKLKVNKLQVTVGKKPVTGMRLFLEGKRCDKLAIHLQHLSAIPKFLQSLWEDHPFAREATWQDPDDYSTKYFEPVQWKNFSHICTAPVENTETWMGDHAGASVVVGAQLAVKSFGLRNVLYLRLLYSKIPEAKIRRSEWDHMPASTQKSGMFSNFLSTTFSSAPAAPAKVPAVVMNSGIYPEGPPTPVRDPKLLKFVDTTEMTKGPQDMPGHWLVTGAKLYLDKRKIALRVKYSLLTVSSD

SEQ ID NO: 519 - protein, 266 aa, Tupidanthus calyptratus
MEGGEETVKPIGLRAMESLGLGFDFASDFRLKFAKRCPGAGGDDRLVVLDEASRRDVVFPGGGVIRGVPECIRCDKGDRIRFKSDVLKFNQMSELVNQKSSVQGKVPSGYFNAMFDLSGSWLNDAADANHLAFDGYFISLYYLHLIASPLVLRDKVKNSVPSHWNPASLSRFILTYGTHIIVGLAVGGQDVICVKQRPSSGIPPAELRGYLEDLGDCMFSDGRNPVLERKTRDGKQKVPEVFNRMLQSHTMQFSSITETSSKDVRL

SEQ ID NO: 520 - protein, 552 aa, Adiantum pedatum
MAKRPMSEHFLEVLLLRMCTRFRSEILTFDQMSEHFNQGLSLSGKIPCGFFNNMFNFSGLWQKDASTTRHLALDGWFYTLYTVEIPRSQLVLKEDIKALVPASWEPVALARFIETFGTHIIVGAKIGGKDVIYMKQHQSSPATSVEFQKLLAQVSDERFLQNEGRTSVGSVDNRSHKKPTIEFQSWSAHLDTFSQIVYNDKHHVTIMPRRKGGVDHGQSHSEWIHTVPLSPDIISVSLVPITFLLSGVAGSGFLSHAVNLYLRYKPPVEELRQFLEFQLPREWAPVFSDLPLTLSRKEHSPSTLQFALLGPKLKVSKMQVTVGKKPVTGMRLYLEGKKCDKIAIHLQHLSAIPRFLQPLWEDHPFAGEATWQDPDDYSTKYFEPVQWKNFSHVCTAPVESTETWIGDHAGASVVIGAQLAVKSFGLKNVLYVRLLYSRIPEARIRRSEWDHMPATTQKSGMFSTLLSTTFSSTAAPALAKASPVVLNSGIYPDGPPKPVQDPKLLKFVDTTEMTKGPQDMPGHWLVTGAKLYLDKKRISMRAKYSLLTVGSD

SEQ ID NO: 521 - protein, 647 aa, Platycerium wandae
MASKLDIPNAAKVAHLAIQSLGRGYDLTCDLRFSSFKDRNGTSLIELRNDETVKLSLPGGVVIADVPAIMKCDKGERTRFQSDILTFEQMCQQFNQGLSLSGKVPCGLFNNVFNFTGSWQKDASTTKHLALDGWFYTLYTIEMPRSQLVLKENIKSSVPTYWEPAALARFIETFGTHIIVGVQIGGKDVVYMKQHQTSPSTPIEFQKLLTEVSNERFLQTEGRASIGSKDSRSNKKRNVEFQSWSAHLDTFSQMIYNEKHHVTIIPRRKGGFDHGQSHSEWIHTVPLAPDVISVSLIPITFLLHGVAGSGFLSHAVNLYLRYNPPIEELRQFLEFQLPRAWAPVYGELPLTLPRRESSLPTLQFRLMGPKLKVSKLEVAVGKKPVTGMRLFLEGKRCDKLAIHLQHLSAIPKFLQPLWENHPFGREVTWQDPDDYSTKYFEPLQHLSAIPKFLQPLWENHPFGREVTWQDPDDYSTKYFEPVQWKNFSHVCTAPVENTETWIGDHAGASVVVGAQLAVKSFGLRNVLYLRLLYSKIPEAKIRRSEWDHMPASTQKSGMFSSFLSTTFSTTPVPPKVPAVVINSGIYPEGPPRPVRDPKLLKFVDTTEMTKGPQDMPGHWLVTGAKLYLDKRKISLRVKYSLLTVSSD

SEQ ID NO: 522 - protein, 640 aa, Asplenium antiquum (Crissie)
MASAVAGLAAMQAQSSEAAQPPKMSSTAFSIAQQAVDALGRGYNVNFDLSLSYCKQGKRLIDIDESGPTQDLLLPGNIIIPNMPASIKCDKGDRTRFTTEVLKFNEMSEQFNQNLSILGKIPTGHFNTMFDFSGSWQKDASQVKTLAMDGFFINLYTVELPRAQLSLKEEVRAAVPSSWDPAALASFVKKYGTHVIVGVKIGGKDMVCLKQQRTSQLSTVRVQKILEEKAKERFTSIAGGTSKENNKGKIRDGFSYGSNAMNAVNGSKDGLPLSWMNNSLSDLLTVETADVRVMFKRKGGKAVSQSHEEWLHTVPAAPDIVSMSFVPITSLLNGVMGTGFLSHAINHFLRYKPSIAELHHFLEFQLPKEWAPAFGDLPLGPPRKQQASPSLQFRLMGPKLQVNTMPVVVGKSCVTGIRLHLEGKKSNRLAIHLQYLTAVPQILQGLWEDYQPESWEGPDTDFSKYFEPVMWRSFSHVCTAPVESKEPWVDEMKGEPALKGALVVTGAQLDVEQHGSKKVLFLRLLYSKIHKAMNRRSEWDHTPASSQRSGIFSTLMSTPFSSAASSPTKPVHVNSAIYPDGPPPANSQAPKLLKFVDTSAMTRGPLDLPGHWLVTGAKLDVERGKIAVRAKYSLLLYSED

SEQ ID NO: 523 - protein, 616 aa, Doellingeria umbellata
MMEGIEVRALESLGLGFDIASDFRLKFAKRCPDGGGRLVEMDESSRDIVIPAAGASSVVVSGVSQDIRCDKGDRIRFKSDVLEFNKMSELLNQKSSIQGKVPSGYFNALFDLSGAWLNDISDAKYIAFDGYFISLYYLHLTTSPLVLQESVKKSVPTHWNPLLLARFIQTYGTHIIVGMAVGGQDIICVKQKPSSPIPPGELKRYMDDLGDSLFSDGRSPSLMERKTRDGKQKVPDVFTRMLQPHTVQFSNITETSSKDGLTVIECKRGGDVFSESHSKWLQTVGTNPEAMLFKFVPITSLLNGVPGSGYLSHAINLYLRYKPALEDLQCFLEFQVPRQWAPLFCELPLRHQRRKTSCPRLQFSFMGPKIYVSTTQVLSDDKPVIGLRLFLDGKKSNRLAMHVQHLSSLPDTITHTSSKSTINHRPSQWRGSDEYESSAQFLEPVRWKRFSNVCSSVVKHDPNWLTEEPSGGVYIVTGAQLVTKGKWPKTILHLRLLFTHLPNCTIRKTEWAGAPAVARKSSRFTNLSSTFSFTQRSVANAPKQQSETLNSGVYPDSPPVPVRSTKLRKFVDMDEVARGANDSPGHWLVTAGKLVMDGGKIGLHVKFALLDFAQEL

SEQ ID NO: 524 - protein, 302 aa, Prostanthera rotundifolia
MRFSSDVLSFQQMSEQFNQELSLSHKIPTGHFNAAFEFTGSWQKDAAFTKSLAFDGVFITLYSIALEKSQVTLQDHVKQAVPSSWDPAALARFIEKYGTHIIIGVKMGGKDVVYVKQHYSSPLQPIDVQQRLKDAADKRFSDANGQSSMHPEKSYGREMPVSNERGFAFSDPGTPSFHSNQEEFTFFWRRRGGGSDRNMPHTKWSQTVQIEPEVISMSFIPISSLLSGIDGSGFLGHAINLYLRYKPPIEELHQFLEFQLPKQWAPVFGNVPLGPDRKQQGAASLQFSLMGPKLYVNTEEVD

SEQ ID NO: 525 - protein, 688 aa, Blechnum gibbum
MASAVGGLAAMQAQSSEGAPLQNTASLAFSVAQQAVDALGRGYDVNSDLWLRYCKRGERLIENDNSGPTQDLLLPGNIIIPNVSTSIKCDKGDRMRFTSDVLTFSEMSEQFNQNLSISGKIPVGHFNAMFGFSGSWQKDASQVKTLAMDGVFINLYSVELPRAQLTLKEEVRAAVPSSWDPAALASFLEKYGTHVIVGVKIGGKDMICLKQHRSSTLAAVGVQKILEAKAKERFSSVEGSAAKEKINKGKIRDGSAHEANGMNAVFGSKDGMPLSWMNDTAPDLENDDVTVICKRKGGKDISQSHDEWLDTVPSTPDIVSMSFVPITSLLNGVTGTGFLTHAINHYLRYKPPIQELHHFLEFQLPKEWAPAFGDLPLGPPRKQQGSPSLQFRLMGPKLQVNTTPVVIGKRCVTGLRLHLEGKKSNRLALHLQYLTVVPQILQRLWEDDQTEEWEGPDDDFGKYFEPVMWKSFSHVCTAPVESNEIWVDEAKGEHGPKGALVVTGAQLDVEQHGSKKVLFLRLLYSKIHKAKIRRSEWDHTPASQHKSGIFSALMSTPFTAQAAPVKPVHVVINSAIYPQGPPPAKSQAPKLLKYVDGIFSSLMSTPFTAQAAPVKPVHVVINSAIYPQGPPPAKSQAPKLLKYVDTTEMTRGPLDLPGHWLVTGAKLFVDNGKIAVRAKYSLLLYSVD

SEQ ID NO: 526 - protein, 425 aa, Lygodium flexuosum
MKPAAATIRPNFYTSSSSSAPSDPASVAKQAVDALGRGYDVTGDLWLSKCREPLIVDLAESSPTQDLAIPGGISLPSVPAPIKCDKGDRTRFASDILSFSEMSEQFNKTLSIAGKIPLGLFNSMFGFTGLWQKDASSTKTLALDGVFINLYSVEVPRTHLNLREEVRKAVPSSWDPAALASFVDKYGTHVIVGVKIGGKDVIYVKQRHSSPLSAVSIQKILETKAVERFSSGETCTSKEKLTKGKDFQTKGIHGAEPNGQNGNLLRGHVDGMENSESFSLMEDSSTFSIDGDVTVIYKRKGGSESCQSHNDWLHTVPLAPDVVSMSFVPITTLLNGVPGTGFLSHAINLYLRYKPPLQELSNFLEFQLPKEWAPAFGDLPLGPPRKQQEVPSLQFRLMGPKLHINTTPVNNNLYTTCMLSRVISA

SEQ ID NO: 527 - protein, 416 aa, Tupidanthus calyptratus
MGGKDVIYMKQQHSSSLQPSDVQKRLKTIADKRFVDARGQSGMDSEQTYQKDKFQVREQRLRFADTSLSSSYSYKEDIVSICMRRGGNDNKNLTHNEWLHNVQLEPDVISMSFIPITSLLNGVSGSGFLSHAINLYLRYKPPTEELHQFLAFQLPLHWAPVFSVHPLGLQPRQQSTASLQFSFMGPKLHVNTSPVDVGKRPVTGLRLYLEGKKSNRLAIHMQHLSSLPEFFQLEDDPNGNFRQESYDRRYYEKVQWKNFSHICTAPVESDEDLSIVTGAQFGVGDYGFKRVLFLRLRFSTVRGGLAVKNPEWDGSPGLARKSGLISTLISHHFTATLKPPPQPADVNINSAVYPGDPPGPAQAPKLLKFVDTTEMTRGPQDSPGYWVVSGARLMVEKGRISLRVKYSLLAAILPDE

SEQ ID NO: 528 - protein, 636 aa, Campyloneurum angustifolium
MASAAGGFVAMQPQSSEAVPPQNTPLSVAQQAVDALGRGYDVNSDLWLRYCQHSERLIENSPGPTQDLLLPGNIVIPKVSATIKCDKGDRTRFTSDVLTFNEMSEQFNQNLAISGKIPVGHFNSMFGFSGSWQRDASAVKTLAMDGVFITLYSVELPRAQLTLKEEVRAAVPSSWDPGALASFLEKYGTHVIVGMKIGGKDVICLKQNRSSSLSAVGVQKILEAKGKDRFSSVEGSVAKEKINKGKIRDGSPFGSNGMNAVNGSKDLPWMNDSSAEYSTVETEDVTVIFKRKGGRDLSQSHDEWLHTVPQHPDIVSMSFVPITSLLNGVTGTGFLNHAINHYLRYKPPIQELHHFLEFQLPKEWAPAFGDLPLGPPRKQSGSPSLQFRLMGPKLQVNTTPVVIGKRCVTGLRLHLEGKKSNRLAIHLQYLTVVPQILQQLWQDDQPEEWEGPDDDFSKFFEPVMWKSFSHVCTAPVESTEAWEDEGKGGPGSQGAKVVTGAQLDVQQCGSKKVLFLRLLYSKIYKAKIRRVEWDHTPASQQKSGIFSTLMSTTFSSAQATPQKPVQVVVNSAIYPQGPPAAKSQAPKLLKFVDTTEMTRGPLDLPGHWLVTGAKLFVDRGKIAVRAKYSLLLYSVD

SEQ ID NO: 529 - protein, 538 aa, Selaginella victoriae
MEDSKALTPTGSDDNHSGSQATIAGTEEVIGAASDYDTLPGCEIIGCGYDVLNGRYADATSCRSNLFDIPKEYETVKIADRYFSKPEQIVYQSNIQVLEYTSKGSTITEYTESVTSKMKVEGKYNFFSAEVEASIGMSSAQNLQNEFVQLQQTVSYYNLQLPVNHKDLLKPSVKDDIDNIENTAELFDRYGTHYLAGIIMGGSAMYTSTTNKMSFESSTELDVVAKMSYDELVGSISAEDRTKYEQKIKNFRESSTTELHNKGGDPGLSGQNFPANAEEWNKSVIDYLAFCEFLSSDQSLLGIWELASTPARSKQIQDSYHDYCRDKQTKYNVDPPYLQAKIVPLKRVQFTDTGSHAHDYLTVCIPDVDSGWYYLGQVAFPGGGARGSTIVVKELVAGALIDVKWWQWVWDDSGSHNSKDFSLWYGNSANPVEYYVLGDFFRGGVEHTSPVSAPTANEVAGIKAVSSKCVVEATVGDRIWHDEGTHATYDGSVWKIIPKSGSNAIDTSNMDLYFIASGSWDKPNRPVYLLNKDAVEFV

SEQ ID NO: 530 - protein, 604 aa, Selaginella biformis
MVMSGSEAKAVAAIRALGRGFDVTLDLKLEYAKSCLIEVDQETREIIVPGNVVVENVSKDIKVDKGENMRLRSGVLDFHQMSERFNHKAGIAGKMPLGLFTAMYDLKGPWQVDALSTKSLAMYGYYAILYEVKVTKAPLSLLQEVKNAVSSTWQPLELTRFIEKYGTHIITGVKVGGKDVIYLRQNQSSTLNAADIQRYLESIAEQRFADGGGRSSRRFKVFKKGAKKKVADPFAMIDRSKVINNYSSISISNNNVEVKFKRRGGLDSIRDHNPWLLSVPDAPEVVTMSFVPITSLLAGVPGTGFLTHAINLYLRYKPPIEELQYFLEFQVPRQWSPSLDPSTSQTSSGKLPALQFSPMGPKLHVDTDEVAVGKRPVTGLRLYIQGKKLNRLTVHLHYLSSLPKILEQHWGANSTTTYSDAPRWRRSEDDRQWLEHVQWKSFSHVNTAPVEYVEPCIGDEASAFLVTGAQLQVSDSRTRPVLFLRLQFTRVPGCSIRRSVWDHMPATSQKSSSTGFFSQFGFSSSVNTPNSQNKQPQRFVQNSAVFSGGPSRSVHGSRLLKFVDISEMSKGVQDEPGHWIVTGAKLDVENGKICLKVKYSLLRY

SEQ ID NO: 531 - protein, 284 aa, Huperzia carriata (Solomon Islands)
MLTPSFKEALASMDSDELFTTYGTYYLSEVLVGGRADYVATTKTSAFSSDTQIGVVAESSFKSVAGMEVSSQYKELIKKFQENSSTSLYAIGGSAISSITDTATYNKWLSSIDTLPVFCGFTSASLMPIWELAESPQRQEILKKATQTFIPLEIRRNAIVEVAIIVSSDHQVKPLYGFTKIDFDLNSGAKGKFIYLCYKQQKISVAGSPADPKPITALKVVSSDYHNPSAPSGYIQLDQDLNDGAGGKFIYLCYTKDPAAIPNDEGCNTQRRGWTAHTWHPRYW

SEQ ID NO: 532 - protein, 478 aa, Platycerium bifurcatum
MEPNKGGAPAMKNVAKPSTKRLIPSSIAASSQTSANALTEPLPGSDAIGQSYDAFGFFANPRSIMKELFEFSPQEEIVVEGNTWLLSSDFVYTAIRDTETSTVSRRTKDDYSKELAVKVKLSGSYGFFSASVESDFSQSISDVTDTTYTSVRTHVNKWRLSLKDDVGALRSKLLPGVKQALATMDATQLFDTFGTHYVSEVLVGGRADYVATTKTSAFSSSTSISVAAEASFQSIAGGEVSPESKVLAETLRENSSTRLYALGGSALPNITDPATYNAWLESIDTIPVFCGFTQNSLKPISELADSAQRRDALAKASQSYIPSYVTRPAVVGLEVIISDSNSESPPYGYTRIDYDLNRNAGGKYVFLCYKQKNISVGGDADAITDVLVVYGNDRNPSVPSGYTKIDKDLNSGAGGKYIYFCYSKDKRKQEEGLPIRGLRVVGPHPTSVAPYGFSKIDIDLNMGAGGDFIYLCKSRHLE

SEQ ID NO: 533 - protein, 451 aa, Huperzia squarrosa
MAHIEPLPGSDAIGHSYDVFGFYANPKSVKKELFDFALQKEITSEGHTWLLSTDIEYIAVRDTEIKTVSIRTKDAYSSELAASVKLCGSYGGFSASVESDFSESISDETDSTYTSVRTNVNKWKLSLKHTVEELRSKLKPALKEALASMKAVELLSTYGTHYMAEVLVGGRADYVATTKNSAFSSDTKISIVAESSFKSVAGMKVSAEQKQLIEKFQENSSTSLYAIGGSALSSITNTATYNAWLSSIDTRPVFCGFTRDSLRPIWELAESPRRREILRTATQTFIPSGITRNAIVGVDIIVSDNYSVNPPYGYTRRSYDLNRNAKGKYIFLCYKQQKISVAGSPADPTPITALYVASGDDDNPYVPPGYTKIDKDLNKDHGGKFIYLCYTKDPAAIPNDEDGLPIRGIRVIGSKKVENVVTPYGYTRIEEDLNKGAGGDYIFVCFSRHLD

SEQ ID NO: 534 - protein, 441 aa, Selaginella biformis
MLSGNLAQDFHGLGTAVYLPTIDVLDNVASRRSIFASNVSSLVIKQKYPLVKRSSTFLQDSKELYEELAQTAGVTGTYNSITFSMDQSFKSVSKSKTETTSLYIYCYSFNSKLELIKSKLDKVPLSDAFLKDFRSLPRTINNPSLQSSWVPFADFMRNWGSHFVSAVYQGAWIQQWSVAKSSSKYSQKDFALRACLKLEGSKKLDIDVCAGFSTAEKSSASRLEMSDTLYVKGGTDATRSKLQDARTKELLDKFMLEGSTSEAPVQYNYEPLWQIIRERFPLLSTEWMIARNLEAYYEGFKAFGCELMKSSTGRNIQVLQAVPDSYGTHYTCVRMCRGCHDDNDCHIGGAGSVCYCYGPTCIKVNGNNRPVVQNTHNGKSYDEGENISCRYQVGVWCGCRRSYYYDEPGCDAGGYVTIWDQSTIRYHANSTAGTSTPVAVE

SEQ ID NO: 535 - protein, 323 aa, Selaginella pallescens
MAEHSEQKGSLILESLEEGRKLPGTEILGSGYDVLGGYYADPRSCLVNLFDFPAEVETVQIGNQEFSKSTGIVYHSSIGTDLDMSSGKSIQEYTKEINSKTKLEGNYSFFSASIEADIGIKSAQKSENEFSKAQYNVKFFTLQLPPHHSKMLKPQIKDDIDNMSDLVRLFDMYGTYYLAGILMGGAASSTSSTSTSTFNSSLDVSVAAKIAFQWSIGGLSAEEQAEYKQQVKSFNESSETTVRTTGGKPGIKFPAEIGEWSDSILDYMAFVDYLGSRSLVGIWELASTRERQDELHKFYHKYCRFRQMQIIPLLRARVVCADE

SEQ ID NO: 536 - protein, 451 aa, Huperzia tetratoides
MAHIEPLPGSDAIGHSYDVFGFYANPKSVKRELFDFAPQQEMTSEGLTWLLSTDIVYNAVRDTEIKTISHRTKDAYSSELAASVKLSASYGGFSASVETDFSQSISDETNSTYTSVRTNVIKWKLSLKEIVEELRPMLTPSFKEALASMSAEELFATYGTHYLIEVLVGGRADYVATTKTSAFSSDTEIKVVAESSFKSLAGAEVSSDYKQLIQKFRENSSTSLYAVGGSALSSITDTATYDAWLSSIDTRPVFCGFTTDSLKPIWELAESPERREVLQKATETFIPPEITRNAIVGVDIVVSDNDAVNPPYGYTKINYDLNSNAKGKYIFLCYKQQKISVAGSPADPKPITALYVASGDNNHPSIPSGYTKINVDLNQGSGGKYIYLCYTKDPAAIPSDEDGLPIRGIRVIGSPNSGDVVTPYGFTRINKDLNEGAKGDFIYVCFSRHLD

SEQ ID NO: 537 - protein, 380 aa, Asplenium australasicum
MQLGTTFGLSVPLKVLRLSFSTTFRTIAGSQTNVSSALVLVESYSKRQLILNEQRSIQQIPLRADFLQELRNLPEPPTSITAATQWASYRDFLIRWGSHYASEVYYGSWLRTWATAASTKSYTQRQITAKGCADLTGASPIPTIQGCAGIDTAEMTAASRLDVNVQIEVRGGEPATRAQLTVRRTDQLIQDFVQQGQENDDAAVKYGLVPIWRPILARYHSPSSKEWRVATALEGYYNGFLAFSCPYLTLPDPFTVLQLFRRTSVGTYQCVRQCQGCRRNGDCNVGGASGCYCYGRTCIAALGEDGRASIQTSRDQLPRDVPPNVNCFYNFPSCDCNLTSKEPNCGSDNLIPIWDQAKLVSTASLYTTNSNTAEALSTAE

SEQ ID NO: 538 - protein, 613 aa, Selaginella kraussiana (Variegata)
MTDAYEWMKTLPGCDTIGSGYDILNGYYADARSCLENLFDFSSVDNEIVVVSGTQYTKPKVLTYHSSIQTDLHMSEGESIMEYNRSVNMKTKLEGEYNFFSASVELDIGKASAENQENSFSRIQENVSYFTLQLPSSYCDLLIKPRMKKDIDEMTDLTKLFKTYGTHYVSGMIIGGSATYTASTNKTTFKSKLGLGYVAKMSYQALVGGLSAQLESQYGEDIKAFNQASSTKLMAKGGDPAYGGHDFPKHTKEWRNSVKDNLAFVDFLSNRGLTGIWNLASTDARSKQIEGHYAEYCEKSQTNFNMESPLIRAKIVPLTKVQFTDTGSRASLELAVCIPDIGSDWYYLGQVAVPGHNLPKGSTLAVQEIKPGALVKVNRWEKIWDDQGSGARNDYNLWRGLAENPVDYHVLSDFFRGNVDGYNKQEPPTEQDTRGIVAVHSSCVVPAQVGKMIWNAGGTGASNEASVWQIISTTGLANLMDNLSKTTMDTSHVDLGYVGTADISDGELGLPTKPPPGGNVSTAISNGELGLPTKPPPGGNVSTAISNGELGLPGGNVRTTDFKPPAPQSSIISNRAESIDTSKILPYYVSTLDNYKPHRPVYLLKKSAVQFVN

SEQ ID NO: 539 - protein, 421 aa, Selaginella victoriae
MKVEGKYNFFSAEVEASIGMSSAQNLQNEFVQLQQTVSYYNLQLPVNHKDLLKPSVKDDIDNIENTAELFDRYGTHYLAGIIMGGSAMYTSTTNKMSFESSTELDVVAKMSYDELVGSISAEDRTKYEQKIKNFRESSTTELHNKGGDPGLSGQNFPANAEEWNKSVIDYLAFCEFLSSDQSLLGIWELASTPARSKQIQDSYHDYCRDKQTKYNVDPPYLQAKIVPLKRVQFTDTGSHAHDYLTVCIPDVDSGWYYLGQVAFPGGGARGSTIVVKELVAGALIDVKWWQWVWDDSGSHNSKDFSLWYGNSANPVEYYVLGDFFRGGVEHTSPVSAPTANEVAGIKAVSSKCVVEATVGDRIWHDEGTHATYDGSVWKIIPKSGSNAIDTSNMDLYFIASGSWDKPNRPVYLLNKDAVEFV

SEQ ID NO: 540 - protein, 303 aa, Huperzia phlegmoides
MNSEELFTTYGTHYLSDVLVGGRGDYVATTKTSAFSSDTQISVVAESSFKSVAGMDVPSDYKELIEKFQEKSSTSLYAIGGTALSSITDTATYNAWLSSIDTLPVFCGFTSASLRPIWELAESSQRQQILQKATQTFIPLEIRRNAIVDVDIIVSDNSSVNPPNDHTKIDYDLNRNAKGKYIFLCYKQQKISVAGSPADPKPITALYVASGDDDNPYVPPGYTKIDQDLNKDAGGKFIYLCYTKDPAAIPNDEDGLPIRGIRVIGNEKLENVVTPYGFTRIDEDLNKDAKGDYIFVCFSRHLD

SEQ ID NO: 541 - protein, 486 aa, Equisetum arvense
MAFQMQVFLRMRAMAVAVLLMVCGTKIATCDTIPDVIVGAKSALGKIVNLPRSNILDSLNSGHPLFTAHPESNTEPYSRGGSSLQYFQTSDKLKQHISSDANLDTSAASSLSVTMKTTFDHISGFETNVSVAKAYAESLVSVSYVTKEHLDKLTLRPDFLASFNALPITVANEWTPSAWYHAAEFLETWGTHVIVAAYTGATFDTYSVAKSSLDYSQQELEARACLHAEGFNQALRGCGGFSEAQKKNAATLSANDKRYAKGGSSTTRNRLLSQEVTKEVLDKFLSEAAVDEEPVKYHFMPLWSLLRSRYAARSEEWRRATNLGAYYDGWLGFGCRYVEMKENGVVEPAQWFRFDVNNIGYARCLRRCLGCHSDHQDCFNSNNVCMCGGPSCLVPMTDEAKHGYHVRVENNRRHAWEGMGCDANEQNQCTCENKDSEVGCHVQLNQSSHIRFRAIWDQTPAMFRDLTTTFTSTLPENTPAIIPNAN

SEQ ID NO: 542 - protein, 270 aa, Huperzia carriata (Solomon Islands)
MLAENTKISIVAESSFKSVAGMKVSAEQKQLIENFQENSSTSLYAIGGSALSSITDTATYNKWLSSIDTLPVFCGFTSASLMPIWELAESPQRQEILKKATQTFIPLEIRRNAIVEVAIIVSSDHQVKPLYGFTKIDFDLNSGAKGKFIYLCYKQQKISVAGSPADPKPITALKVVSSDYHNPSAPSGYIQLDQDLNDGAGGKFIYLCYTKDPAAIPNDEDGLPIRGIRVIGNAKFVNVITPYGFTRIDKDLNEGAKGDFIFVCFSRHLD

SEQ ID NO: 543 - protein, 311 aa, Huperzia squarrosa
MQSDAIGHSYDVFGFYANPKSVKKELFDFALQKEITSEGHTWLLSTDIQYIAVRDTEIKTISLRSKDAYSRELAASVKVSGSYGGFSASVESDFSESISDETDSTYTSVRTNVNKWKLSLKPTVEELRSMLTPSFKEALASMNSEELFTTYGTHYLSEVLVGGRADYVATTKNSAFSSDTQISVVAESSFKSVAGMDVSGKYKELIQKFQENSSTSLYAIGGSALSSITNTATYNAWLSSIDTRPVFCGFTRDSLRPIWELAESRQRQEILQKATKTFIPPEIRRNAIVGVKFIVSDNSWVNPPYGYTKIL

SEQ ID NO: 544 - protein, 520 aa, Selaginella pallescens
MAYNRSVNMKTKLEGEYNFFSASVELDIGKASAENQENSFSRIQENVSYFTLQLPSSYCDLLIKPRMKKDIDEMTDLTKLFKTYGTHYVSGMIIGGSATYTASTNKTTFKSKLGLGYVAKMSYQALVGGLSAQLESQYGEDIKAFNQASSTKLMAKGGDPAYGGHDFPKHTKEWRNSVKDNLAFVDFLSNRGLTGIWNLASTDARSKQIEGHYAEYCEKSQTNFNMESPLIRAKIVPLTKVQFTDTGSRASLELAVCIPDIGSDWYYLGQVAVPGHNLPKGSTLAVQEIKPGALVKVNRWEKIWDDQGSGARNDYNLWRGLAENPVDYHVLSDFFRGNVDGYNKQEPPTEQDTRGIVAVHSSCVVPAQVGKMIWNAGGTGASNEASVWQIISTTGLANLMDNLSKTTMDTSHVDLGYVGTADISDGELGLPTKPPPGGNVSTAISNGELGLRNVGTAGIVGGTTTWEPTKPLPPQSSIISNRAESIDTSKILPYYVSTLDNYKPHRPVYLLKKSAVQFVN

SEQ ID NO: 545 - protein, 373 aa, Huperzia phlegmaria
MAQIESLPQSSDYAMDQIEPLPGSDAIGHSYDVFGFYANPKSVKKELFDFALQKEITLEGHTWLLSTDIVHIAVRDTDINTVSLRTKDAYSTELAASVKVSGSYGSFSASVESDFSQSISDETDSTYTSVRTNVNKWKLSLKHTVEELRSKLKPALKEALANMKEVELLSTYGTHYMGEVLVGGRADYVATTKTSAFSSDTKISVVAESSFKSVAGMEVSAEYKELIKKFQENSSTRLYALGGSALSSITDTASYNAWFSSIDTRPVFCGFTRDSLRPIWELAESPQRREILRKAAQTFIPPEITRNAIVGVDIIMSDNYWVNPPYGYTKIDYDLNRNAKGKYIFLCYNQQKIFVGIPCGSDAHHCLVRGFWR

SEQ ID NO: 546 - protein, 392 aa, Selaginella victoriae
MSFPIKKLMFSFDTSFQAISGGRQEIKAAVLQVESYSRRSFFRNNLALQLNPTLVQDLNSLPEPPTITAHRHDWRNHENFLRKWGSHYMTEVRYGSWMRQFTSAASTETYSEIEMKANACARLFGGKLSKIGACAGITQQQINANSNLRVRLTTEVRGGNAQTAAQLRRIPVQESVIESFKVEGRNSNEAVVYHFAPIWQAIKARYSVQTRQWRQADALESFYVGFLAFDCPQRILNTGSSSEPTTLLQQFRRRGEKFQCVRHCVGCRRSKDCNFHTTGNGAPGCYCYGNSCLVAQGAESRIAIQTRRDNLPRNVNPNRSCQQSGVSGCKCDRNPRENGCGADNMIEIWPQTPRNPNPGTLNAYEETGVDIVDDMIMVQEDEVVYDEMKNIM

SEQ ID NO: 547 - protein, 367 aa, Selaginella biformis
MSVPVKVLQLNFEASFNKISGSKTSVKTASVFVETYNQKISLRNHARAIQTLQLNPDFLRDLRNLPEPPNSDSAWGPYRSFFNKWGTHYVSETFHGSWLRQWTVASSTETFTERQMQAKACAKLTGLKGIVPNLGGCAGISLEEMRSAERINTQDTREARGGSPATVSQLLSGSVTDDLIRKFIEEGATSKEAVRYGFVPVWMPVLAQYMSSTSKEWRVATALQAYYEGFLAFSCPVNRLNTPSTVLQQFRRLSNGKYQCVRQCQGCRLDKDCNVGTSGASTGCYCYGGSCINALGPDGRAQVQQKKDNLPRNVLPNRSCEYSFPQCRCNTKSKEPNCGADNMIPIWDQDRDTFQSLDSNILLYDEE

SEQ ID NO: 548 - protein, 338 aa, Asplenium nidus var plicatum
MHCQLIPLRADFLQELRNLPEPPTSITAASQWVSYRDFLLRWGSHYASEVYYGSWLRTWATAASTASYTQRQITAKGCADLTGSSTIPTIGGCRDISLSEMTAASRLDINVQIEVRGGEPGTRAQLTVRRTDQLIQDFIREGQVNDEADVKYGLAPIWRPVLARYHSATSKEWRVATALEAYYNGFLSFPCPYNIENGIVLQQFRRITTGTYRCVRPCQGCRDFHDCNLRQFGCYCYGSTCIAAGGDDNRAWIQRWFTGSRYYPPSSSCYYQFPSCRCNYGWREANCGTDRTITIWDQTKVNVGVHGNETVVEALSIENNVWVSPANSSNIAEAMSFE

SEQ ID NO: 549 - protein, 503 aa, Selaginella victoriae
MDQHTLPGCEILGSGYDVLNGYYADSRSCLTNLFDFPANYETVKVGSQSFTKPVEISYHSSTGTNLYTDAGNTITEFESSINSRTQIEGSYTFFSSSIDVEIGESSAKSIDNAFSKVNYRVDQYTLQLPPKASEYLKKYVQEDIDKMTDLTRLFDTYGTHYLAKLIMGGVANYSATTKKSKFTSNYDLKVVATMSYKSAVGSLSVSEENTYKQSISSFNQSSTISLKTKGGDPGLGGEKFPEHADEWAKSVENYLSFIDFLGVNSLVGIWELASTAKRMAEIKAYYGTYCEIRQKHYFLDDGPLLRARIVQLSKVQFTDAGSGAKRDLSVCIPDIGGGWYYLGQVALPGGGATGNTLVIQEKYPGSGVLLDVDHWEKVWDDHGSKKPKDYSLWRGVAANPVDYVVLSDFFRGGVSSQYEPTAEETVGIKAVAQACVVRGKVGEMVWNDEKSKASDDGSVWSIVPADNTAINTSSIKPYYVSEKSHKSPSRLVYVLKKTAVEFV

SEQ ID NO: 550 - protein, 510 aa, Selaginella victoriae
MDLDAAPMDQHTLPGCEILGSGYDVLNGYYADSRSCLTNLFDFPANYETVKVGSQSFTKPVEISYHSSTGTNLYTDAGNTITEFESSINSRTQIEGSYTFFSSSIDVEIGESSAKSIDNAFSKVNYRVDQYTLQLPPKASEYLKKYVQEDIDKMTDLTRLFDTYGTHYLAKLIMGGVANYSATTKKSKFTSNYDLKVVATMSYKSAVGSLSVSEENTYKQSISSFNQSSTISLKTKGGDPGLGGEKFPEHADEWAKSVENYLSFIDFLGVNSLVGIWELASTAKRMAEIKAYYGTYCEIRQKHYFLDDGPLLRARIVQLSKVQFTDAGSGAKRDLSVCIPDIGGGWYYLGQVALPGGGATGNTLVIQEKYPGSGVLLDVDHWEKVWDDHGSKKPKDYSLWRGVAANPVDYVVLSDFFRGGVSSQYEPTAEETVGIKAVAGACVVRGKVGEMVWNDEKSKASDDGSVWSIVPADNTAINTSSIKPYYVSEKSHKSPSRLVYVLKKTAVEFV

SEQ ID NO: 551 - protein, 319 aa, Selaginella victoriae
MESKDWLPGTYSIGSGYNVLTGYYADSKSCLTGLFQFPEKYETVKVGEKYFSKPKSISYHPSFHTYEYTAQGKSIIEYTQNFNSKTKVEGEYNFFSASIEEEIGISSAENLEKQFSKVHHIVELFTLQLTPHHKSLLKPKVKEDIDTMHNLTKLFNKYGTHYLTGLVMGGTATYTAITSKTTFESSFNLGLVANMAYKSAVGSLSAEEKAKYNQSIKSFCESSSTKLETKGGDPALGGASFPQHASEWSKSVLEYMAMVDFAALRGSGSSPLPKNVKSRYTPSIPTTASRTKSGTTLTDHSCVPKLCPCRPKSSPISSP

SEQ ID NO: 552 - protein, 252 aa, Huperzia carriata (Solomon Islands)
MAGMKVSAAHMQLIQKFQENSSTSLYAIGGSALSSITDTATYNKWLSSIDTLPVFCGFTSASLMPIWELAESPQRQEILKKATQTFIPLEIRRNAIVEVAIIVSSDHQVKPLYGFTKIDFDLNSGAKGKFIYLCYKQQKISVAGSPADPKPITALKVVSSDYHNPSAPSGYIQLDQDLNDGAGGKFIYLCYTKDPAAIPNDEDGLPIRGIRVIGNAKFVNVITPYGFTRIDKDLNEGAKGDFIFVCFSRHLD

SEQ ID NO: 553 - protein, 252 aa, Huperzia nummarifolia
MAGVKVSAAQKQLINKFQENSSTRLYAIGGSALSSITDTATYNAWLSSIDTLPVFCGFTSASLLPIWELAESSQRQDILQKATQTFIPLEIRRNAIVDMDIIVSDNYVVNPPYGFTKIDYDLNRNAKGKYIFLCYKQQKISVAGSPADPKPITALYVTSGDDYNPYVPPGYTKIDKDLNKDAGGKFIYLCYTKDPAAIPNDEDGLPIRGIRVIGNEKIENVITPYGFTSINTDLNDGAGGYNIFVCFSRHLD

SEQ ID NO: 554 - protein, 597 aa, Selaginella pallescens
MVISGAETKAVAAIQALGCGFDVTLDHKLEYAKSRLVDLDPETRTVVVPGNIIVEDVSMDIKVDKGENTRLRTDALDFHQMSERFNQGCGIPGKMPLGLLTAMYDLKGPWQLDALSTKCLAFDGYIAVLYEMKVAKSLISLLREVKDAVPSNWQPLELTRFIEKYGTHVITGVKVGGKDVIYLRQSQSSKLSAVDIQRYLESLAEQRFADGSGRRFKVFKKGAKTKVADPFAMIDRSKVINNFSSISISDDNVEVKFKRRGGLDSIRDHGPWLLSVPNAPEVVSMSFVPITSLLAGVPGTGFLTHAINLYLRYKPPIDELQFFLEYQVPRQWSPTLDASNQTSSSNLPALQFSPMGPKLHVSTDEATAGKRPVTGLRLYIQGKKLNRLTIHLQHLSSLPKILESHWGASNTYNDAPQWKSCEDEPRWLEPVQWKSFSHVNTAPVEYVEQCIGDETGDFIVTGAQLEVSDSRTRPVLSLRLQFTRVPGCSIRRSVWDNMPAMQKSSSGFFSQFGFSNVSNAQHKQQQSQQQRFVQNSAVFSGGPSRSVHGSRLLKFVDVSEMSKGVQDEPGHWIVTGGKLDVEGGKICLKVKYSLLKY

SEQ ID NO: 555 - protein, 311 aa, Platycerium bifurcatum
MKEVERLSTYGTHYMGEVLVGGRADYVATTKTDFVATTKNRAFSSDTKISTVAESSFKSVAGMKVSAEQKQLIEKFQENSSTSLYAIGGTAISSITDTDTYNAWLSSIDTCPVFCGFTYESLQPIWELAESPQRQEILQKATKTFISPEIKRNAIVDVDIIVSDNYGVNPPFVLQATEDDLNRNAKGKFIFLCYNQQKISVAGSPADPKPITALYVASGDDDHPYVPPGYTRISSDLNEGAGGKFIYLCYTKDPAAIPSDEDGLPIRGIRVIGNENIDNVVTPYGFTKIDKDLNEGAGGDFIYVCFSRHLD

SEQ ID NO: 556 - protein, 287 aa, Asplenium antiquum (makino)
MSFCWRLSGGSSMLGARCSWLGLQGQGQGQGMAASTPSSLGTTFGLSVPLKVLRLSFSTTFRTIAGSQTNVSSALVLVESYSKRQLILNEQRSIQQIPLRADFLQELRNLPEPPTSITAATQWASYRDFLIRWGSHYASEVYYGSWLRTWATAASTKSYTQRQITAKGCADLTGASPIPTIQGCAGIDTAEMTAASRLDVNVQIEVRGGEPATRAQLTVRRTDQLIQDFVQQGQENDDAAVKYGLVPIWRPILARYHSPSSKEWRVATALEGYYKSTMASWRSLVPT

SEQ ID NO: 557 - protein, 335 aa, Asplenium antiquum (makino)
MSTMGGAAVTHVLLLLLLLLLLSASADGAVSIGSTVYLPESNLGAPLSPLRISIFEGDISSFLRNQSLHHTYNTQRFQSTSDSVFGELGTTFGLSVPLKVLRLSFSTTFRTIAGSQTNVSSALVLVESYSKRQLILNEQRSIQQIPLRADFLQELRNLPEPPTSITAATQWASYRDFLIRWGSHYASEVYYGSWLRTWATAASTKSYTQRQITAKGCADLTGASPIPTIQGCAGIDTAEMTAASRLDVNVQIEVRGGEPATRAQLTVRRTDQLIQDFVQQGQENDDAAVKYGLVPIWRPILARYHSPSSKEWRVATALEGYYKSTMASWRSLVPT

SEQ ID NO: 558 - protein, 268 aa, Platycerium bifurcatum
MGEVLVGGRADYVAITKTSAFSSETKISAVAESSFNSMAGVKVSAAQKQLINKFQENSSTRLYAIGGSALSSITDTDTYNAWLSSIDTRPVFCGFTRCSFKSVAGMEVSSQYKELIKTFQENSSTRLYAIGGTTISSITDKDTYNAWLSSIDTRPVFCGFTYESLQPIWELAESPQRQEILQKATKTFISPEIRRNAPEIKRNAIVDVDIIVSDNYGVNPPYGYTKIDYDLNRNAKGKYIFLCYTEDISSRIPCGSEAHHCFVRGFWR

SEQ ID NO: 559 - protein, 394 aa, Asplenium nidus var plicatum
MRSTSNTQRFQRTSDQVFRELGTTFSLSFPIKVLRLSFGATFRSIASSQTNVASALILVESYSRRLLILNEQRSIQQIPLRADFLQELRNLPEPPTSITAAAQWASYRQFLLRWGSHYASEVYYGSWLRTWATAASTASYTQRQITAKGCADLTGSSTIPTIGGCRDISLSEMTAASRLDINVQIEVRGGEPGTRAQLTVRRTDQLIQDFIQQGQDNDYAAVKYTLAPIWRPVLAQYHSSSSKEWRVATALEGYYNGFLAFSCPYLTLPDPYTLLQLFRRTSSGTYQCVRHCQGCRRNGDCHLSGSGCYCYGRTCIAALGEDGRASIQTSKDNQPRNVPPNVNCFYSFPNCKCNLMSKEMNCGSDNFIPIWDQAKVGTLYHANNSNALESLSFE

SEQ ID NO: 560 - protein, 315 aa, Huperzia goebelii (Holub)
MLTPSFKEALASMNSEELFTTYGTHYLSEVLVGGRADYVATTKTSAFSSDTEIKLAAESSFKSMAGMGNSSQYKELIQKFQENSSILLYAIGGTALSSITDTTTYNAWLSSIDTRPVFCGFTRDSLRPIWELAESPQRQEILQKATKTFIPLEIRRNAIVDVDIIVSDNCWANPPYGYTKIDYDLNRNAKGKYIFLCYNQQKISVAGSPADPKPITALYVASGDNNNPYVPPGYTMINKDLNAGAGGNFIYLCYTKDPAAIPNYQDGLPIRGIRVIGNEKVENVVTPYGFTKINTDLNDGAGGDYIFVCFSRHLD

SEQ ID NO: 561 - protein, 449 aa, Asplenium australasicum
MFCVEFLHAADGAVSIGSTVYLPESNLGAPLSPLRISIFEGDISSFLRNQSLHHTYNTQRFQSTSDSVFGELGTTFGLSVPLKVLRLSFSTTFRTIAGSQTNVSSALVLVESYSKRQLILNEQRSIQQIPLRADFLQELRNLPEPPTSITAATQWASYRDFLIRWGSHYASEVYYGSWLRTWATAASTKSYTQRQITAKGCADLTGASPIPTIQGCAGIDTAEMTAASRLDVNVQIEVRGGEPATRAQLTVRRTDQLIQDFVQQGQENDDAAVKYGLVPIWRPILARYHSPSSKEWRVATALEGYYNGFLAFSCPYLTLPDPFTVLQLFRRTSVGTYQCVRQCQGCRRNGDCNVGGASGCYCYGRTCIAALGEDGRASIQTSRDQLPRDVPPNVNCFYNFPSCDCNLTSKEPNCGSDNLIPIWDQAKLVSTASLYTTNSNTAEALSTAE

SEQ ID NO: 562 - protein, 278 aa, Platycerium bifurcatum
MSGGYGGFSASVESDFSQSISDETDFTYTSVRTNVNKWKLSLKPTVEELRSMLTPSFKEALASMDSEELFTTYGTHYLSEVLVGGRADYVATTKTSAFSSDIQISVVAECSFKSVAGMDVSAKYKELIQKFQENSSTSLYAIGGTALSVDSLTKVFSPFGNSLNPLSARRSSKRLRPITALYVASGDDDNPYVPPGYTKIDQDLNKDAGGKFIYLSYTKDPAAIPNDEDGLPIRGIRVIGNENIDNVVTPYGFTKIDKDLNEGAGGDFIYVCFSRHLD

SEQ ID NO: 563 - protein, 406 aa, Selaginella victoriae
MLLRATVAPTASPASSPIARVSVETAETTNMRMKLIMVSKINACRMLVAGMVAPMWSTSAKSCRKTKLALTEPTTWPQVKDDIDNMTELDKVYDTYGTHYLGSIVMGGHASYTSATNKNKFKSSLELGFAAQVAGSLSVEEKVKYKSDIESFSESSSTKIQTSGGDPGLSGPDFPEHVGQWMDSVKEYMTLADFIAGETLGLWKLASTAQRQQQLRDHYSDYCKRNQSHFSGDVRPLRVKVVPLTNTIIENNWFSVSSPDVGGDWSYLGQVWDINGSTIVVAEAEPGSGILGDIARWEKIYEYDNHSYWRGVASNPVDYAVLSDFMKEGDSEPSAEETAGIKAVHTSCLTTEVCTASGYFSHGIYPVQMPYDPSLDNIKPYYWVTGDSEDQRQVHHLKGSCLQVEG

SEQ ID NO: 564 - protein, 463 aa, Selaginella biformis
MADSPLVSVNLRAPVGEHGFRMLKSPVFKEQHLERLWKSIDPHYKQKQLWASDSGTPLGDHDDNLESLPGCNIVGCGYNVLHGYYADARSCLQDLFDLESSGMSKVSVGAKEFAKPNVVIMRPKYATSTYVETGKTIEQYNSSISSKTQLQGEYNFFSASVEVDIGINQAENLQNEFTKVQSDVETFVLQLDVGHEKMLKPQVKKDIDEMKDLDNLYDTYGTHYLRTIVMGGHATYTSSTNKNEFSSEFELGVVASMSFKALVGSISASEEAKYTSSIQSFNESSTTKIETSGGDPGLGGTYFAKHVDEWINSVKDYMTLADFVHGETVPLWRLASTAEREDALQKHYLDYCKRKQTTYTLSGIPPLRVRRVPVTEGFQPYYHVGTPDIGGKRHSTSTSQEGASDRRLSTILPRRHPRHRRQLVLLRSNKWLRLHNCGSGDSARLRCVGAHSQVGKDWRRLWL

SEQ ID NO: 565 - protein, 518 aa, Selaginella biformis
MLKSPVFKEQHLERLWKSIDPHYKQKQLWASDSGTPLGDHDDNLESLPGCNIVGCGYNVLHGYYADARSCLQDLFDLESSGMSKVSVGAKEFAKPNVVIMRPKYATSTYVETGKTIEQYNSSISSKTQLQGEYNFFSASVEVDIGINQAENLQNEFTKVQSDVETFVLQLDVGHEKMLKPQVKKDIDEMKDLDNLYDTYGTHYLRTIVMGGHATYTSSTNKNEFSSEFELGVVASMSFKALVGSISASEEAKYTSSIQSFNESSTTKIETSGGDPGLGGTYFAKHVDEWINSVKDYMTLADFVHGETVPLWRLASTAEREDALQKHYLDYCKRKQTTYTLSGIPPLRVRRVPVTEGFQPYYHVGTPDIGGNWSYFGQTNGYGYTIVVQETQPGSAVLGRIAKWEKIGDVYGCSVWRGVPADPVDYVVLSDFTHRGSNAPTAEETVGIMAVHRSCLISIGSGSGLDNPSWDFCMWGVDPVYNPKVSLLEDLKLYVMVIFSGQGTREMYRLLASELQVED

SEQ ID NO: 566 - protein, 450 aa, Selaginella victoriae
MASFLLSISALLSFSSLTLGSEIYFGNGVDLPRSNLHANQNPTLLRRIFEGNLSRFLHDEPYHQIVNNRKYVASSEELYREFGQTFGISAPIKVLQLSFTQTFDSIASSKNETQSLFIRTESYSRRVFLRNEKRVVQELQLRTEFIGELRNLPEPPSEIKGGEWSDYNNFLRKWGTHYISEVYFGTWLRQWSVASSSSKYSERQLTARACAKLIGTKAISTIGGCAGVSTQEITEAMRYNTRDTTEVRGGSESTAAQLATNLTDEVVKKFLEEGRTSQTPVLYKFTPIWTPVLAQFPSNTKEWRVGAALQAYYEGYSAFGCQYDSLNVPPTILQLFRRTLNGRYECVRQCEGCRRDKDCNVHAGGCYCYGNSCINGNGEDGRAQVQTKKDELARDQGPNRSCEYEFPSCKCNTMSKERNCGRDNFIPIWVQNEDRVSWAKDNNLVLVQDV

SEQ ID NO: 567 - protein, 439 aa, Selaginella victoriae
MVDRAEFMQSSTKVFQFSNPNAPQLIFRENVADFVTNESFSRMVDRAEFMQSSTQVFQFFGISFGMSFPIKKLMFSFDTSFQAISGGRQEIKAAVLQVESYSRRSFFRNNLALQLNPTLVQDLNSLPEPPTITAHRHDWRNHENFLRKWGSHYMTEVRYGSWMRQFTSAASTETYSEIEMKANACARLFGGKLSKIGACAGITQQQINANSNLRVRLTTEVRGGNAQTAAQLRRIPVQESVIESFKVEGRNSNEAVVYHFAPIWQAIKARYSVQTRQWRQADALESFYVGFLAFDCPQRILNTGSSSEPTTLLQQFRRRGEKFQCVRHCVGCRRSKDCNFHTTGNGAPGCYCYGNSCLVAQGAESRIAIQTRRDNLPRNVNPNRSCQQSGVSGCKCDRNPRENGCGADNMIEIWPQTPRNPNPGTLNAYEETGHVNNPE

SEQ ID NO: 568 - protein, 586 aa, Athyrium filix-femina
MCIEQVKAMAESMSSIERALHALCVVGSDEKDNGVTALGSQMLLKQPEGFSLNNASEASDEMLFAFSSSEESSAFQESVMKNGWNANLELKSKQNPFFQIHVSGSLEENMHHREEEKKEGKQHVAYIMKSLYIPKKSFQIPKHNMRLCDSALASVQEVKNLSDALRFLEAYGSHVSQSWYHLGGVLFEVITVSCAETTSLSDLLHEGARAMKASVTACSGFVGSATVKGSSSSSESHKTSSNKASNFKQSAKRVQALGPTNVRDEDEFRSKLEEGPSSWSIINKGVDRVEDLVAVWNILLQQRQYAETDHAKEILERAAMLLYKAWLNKARSSRRQYRQMIAALIECEERNYYRFQHQLQLHHVDEPEEEVSPLAAALTWVSPAVELPQKLQTVLADQSSLDLSPKVSYFLRSCIAHLSSTSGGENDLRKIVIVINRYGYDQYGNAEFSMYAQHLRSMIEDLNKLNRMEENSTDPQHPIDLNWENTSFCLTIDDCLQIPAEYTYIGDVLVDKPLMKQKQGGGQIQSAHARQLILIDRLRHNLDPFQRPSLEGKPKWKRNSSRANKLAWLEHSKIQEAVYLRIFCRS

SEQ ID NO: 569 - protein, 407 aa, Asplenium prolongatum x Asplenium antiquum (Kurata)
MLLNTTPNSREKCPPSSPFRCLYTRCRSVWSQLYHNTHQLTSDSVFGELGATFGLSVLPIEVLRFSLGATFRFLASSQANVSSALILVESYSKRQVLLNERSSLQKIPLRNDFLRELRDLPEPPFSVTADEDWVPYREFLIRWGSHYVSEVYYGSWLRTWSTAASSKSYTALQLQAKACAALTGVASIPAIEACANIDLGDMAEASRLDMNVQVEVRGGEPGTRAQLSVHRTDQLIRDFIEEGQKNEDAVVKYSLLPIWRPVLAQYRSPSTKEWKVATALEGYYNGYLAFSCPYIALSDPLKVVLQQFRRAPNGNGTYECVRQCQGCKRDRDCHLRGIGCYCYGRTCVAAPEGRARNQTSPDRLPRNVPPNVNCQYSFPSCKCHSISKEANCGTENLIPIWKQASGR

SEQ ID NO: 570 - protein, 337 aa, Selaginella victoriae
MSSNNVEVMFRRRGGLDSKKDHSSWLASVPERPEVISMSFVPITSLLSGVPGAGFLTHAINLYLRYKPPLEELHYFLEFQIPRQWTPPLELPSNVSNSGLPVLQFSPFGAKLYVSLEEATVGRLPVTGLRLYIQGKRRNRLSVHLQYLASLPRILASHWGTNVYSETPVWMKSEDNPKWFLPVQWKSYSQVNTAPVEFGASYIGDKGAAFVVTGAQLQVSTHKTRNVLYLGLQFTRIPGCSVRRSAWDNMPTASQKSGSGFFSQLGLSTTLSTLNASPAPERFVQNSAVFSGEPSVSTKNSKMRKYVDITEMSKGIQDQPGHWIISGGKLDVENDQD

SEQ ID NO: 571 - protein, 452 aa, Selaginella biformis
MADSPLVSVNLRAPVGEHGFRMLKSPVFKEQHLERLWKSIDPHYKQKQLWASDSGTPLGDHDDNLESLPGCNIVGCGYNVLHGYYADARSCLQDLFDLESSGMSKVSVGAKEFAKPNVVIMRPKYATSTYVETGKTIEQYNSSISSKTQLQGEYNFFSASVEVDIGINQAENLQNEFTKVQSDVETFVLQLDVGHEKMLKPQVKKDIDEMKDLDNLYDTYGTHYLRTIVMGGHATYTSSTNKNEFSSEFELGVVASMSFKALVGSISASEEAKYTSSIQSFNESSTTKIETSGGDPGLGGTYFAKHVDEWINSVKDYMTLADFVHGETVPLWRLASTAEREDALQKHYLDYCKRKQTTYTLSGIPPLRVRRVPVTEGFQPYYHVGTPDIGGNWSYFGQTNGYGYTIVVQETQPGSAVLGRIAKWEKIGDVYGCSVWRGVPADPVDYVVLSDC

SEQ ID NO: 572 - protein, 451 aa, Huperzia carriata (Solomon Islands)
MAEIKPLPGSDSIGHSYDVFGFFANLKSVKRQLFDFAPQEEITLEGHNWLLSADIEYTAARDTEIKTISDRTTDAYSTELAASVKVSGSYGYFSASVESDFSQSISDETDSTYTSVRTNVTKWKLNLKPTVEELRSMLTPSFKEALASMDSDELFTTYGTYYLSEVLVGGRADYVATTKTSAFSSDTQIGVVAESSFKSVAGMEVSSQYKELIKKFQENSSTSLYAIGGSAISSITDTATYNKWLSSIDTLPVFCGFTSASLMPIWELAESPQRQEILKKATQTFIPLEIRRNAIVEVAIIVSSDHQVKPLYGFTKIDFDLNSGAKGKFIYLCYKQQKISVAGSPADPKPITALYVASGDNNNPYVPPGYTMINRDLNAGAGGNFIYLCYTKDPAEIPSDEDGLPIRGIRVIGNEKVENVVTPYGFTKIDKDLNEGAGGDFIFVCFSRHLD

SEQ ID NO: 573 - protein, 284 aa, Huperzia nummulariifolia
MNSEELFTTYGTHYLSEVLVGGRADYVAYVATTKTSAFSSDTEISLAAESSFKSMAGMENSSEYKELIQKFQENSSTRPYAIGGTRTLQHKDTATYNAWLSSIDTLPVFCGFTSASLRPIWELAESSQRQEILQKATKTFISPEIKRNAIVDVDIIVSDNYGVNPPYGFTKIDFDLNRGAKGKFIYLCYKQQKISVAGSPADPKPITALNVVSSDYHDPSGPSGYTMIYTDLNQGVGGKFIYLCYTKDPAASRWTASYVASALLVTKISTMWLHLTDSRGLMKI

SEQ ID NO: 574 - protein, 276 aa, Huperzia nummarifolia
MLTPSFKEALASMNSEELFTTYGTYYLSEVLVGGRADYVATTKTSAFSSDTKISLVAESSFKSVAGMEVSADYKELIKKFQENSSTRLYAIGGSALSSITDTATYNAWLSSIDTLPVFCGFTSASLLPIWELAESSQRQDILQKATQTFIPLEIRRNAIVDMDIIVSDNYVVNPPYGFTKIDYDLNRNAKGKYIFLCYKQQKISVAGSPADPKPITDLYVASGDNKNPSVPRGYTKINRDLNDGAGGKYIYLCYTKDPAEIPNDEDGLPIRGIRVI

SEQ ID NO: 575 - protein, 448 aa, Huperzia tetratoides
MAHIEPLPGSDAIGHSYDVFGFYANPKSVKRELFDFAPQQEMTSEGLTWLLSTDIVYNAVRDTEIKTISHRTKDAYSSELAASVKLSASYGGFSASVETDFSQSISDETNSTYTSVRTNVIKWKLSLKEIVEELRPMLTPSFKEALASMSAEELFATYGTHYLIEVLVGGRADYVATTKTSAFSSDTEIKVVAESSFKSLAGAEVSSDYKQLIQKFRENSSTSLYAVGGSALSSITDTATYDAWLSSIDTRPVFCGFTTDSLKPIWELAESPERREVLQKATETFIPPEITRNAIVGVDIVVSDNDAVNPPYGYTKINYDLNSNAKGKYIFLCYKQQKISVAGSPADPKPITALYVASGDNNHPSIPSGYTKINVDLNQGSGGKYIYLCYTKDPASDEDGLPIRGIRVIGSPNSGDVVTPYGFTRINKDLNEGAKGDFIYVCFSRHLD

SEQ ID NO: 576 - protein, 499 aa, Huperzia salvinioides
MTRIPLTLQFVNVNKWKLSLKPTVEELRSMLTPSFKEALASMNSEELFTTYGTHYLSEVLVGGRADYVATTKTSAFSSDIQISVVAESSFKSVAGMDVSSKYKELIQIFQENSSTSLYAIGGSALSSITDTATYNAWLTSIDTRPVFCGFTCESLQPIWELAETSERREILQKATQTFIPLEIRRNAIVEVDIIVSDNHLVNPPYGYTKIDYDLNRNAEGKYIFLCYNQQKISVAGSPADPKPITALDVASGDDDDPDVPPGYTRINSDLNEGAGGKYIYLCYTKDPAAIPSDEDGLPIRGIRVIGNEKVEYVITPYGFTRINKDLKKATMTFIPPEIRRNAIVDVDIIVSDNYSVNPPYGYTKIDYDLNRNAEGKYIFLCYNQQKISVAGSPADPKPITALDVASGDDDDPDVPPGYTRINSDLNEGAGGKYIYLCYTKDPAAIPSDEDGLPIRGIRVIGNEKLENVVTPYGFTKIDKDLNEGAGGDYIFVCFSRHLD

SEQ ID NO: 577 - protein, 453 aa, Huperzia tetratoides
MAHIEPLPGSDAIGHSYDVFGFYANPKSVQRQLFDFAPQQEITSEGHAWLLSTDIESIAVRDTEIKTVSLRTKDEYSRELAASVKVNGSYGGFSASVESDFSQSIAQETDSTYTSVRTNVNKWKLSVKPTVEELRSMLTPSFKEALASTDPVELFTTYGTHYLIEVLVGGRADYVATTKTSAFSSDTQLSAAAEMSFKSVAGMEVSAQDKELIKKFQENSSTRLYAIGGTALSSITDTATYNAWLTSIDTLPVFCGFTSASLQPIWELAGSSQRQEILQKATQTFIPLEIRRNAIVDLQVIVSDNHLVNPPYGFTKIDYDLNRGAKGKYIYLCYKQQKISVAGSPADPKPADPKPITALYVASGDNNHPSIPSGYTKINVDLNQGSGGKYIYLCYTKDPASDEDGLPIRGIRVIGSPNSGDVVTPYGFTRINKDLNEGAKGDFIYVCFSRHLD

SEQ ID NO: 578 - protein, 306 aa, Selaginella victoriae (LW10887)
MDQHTLPGCEILGSGYDVLNGYYADSRSCLTNLFDFPANYETVKVGKVGSQSFTKPVEISYHSSTGTNLYTDAGNTITEFESSINSRTQIEGSYTFFSSSIDVEIGESSAKSIDNAFSKVNYRVDQYTLQLPPKASEYLKKYVQEDIDKMTDLTRLFDTYGTHYLAKLIMGGVANYSATTKKSKFTSNYDLKVVATMSYKSAVGSLSVSEENTYKQSISSFNQSSTISLKTKGGDPGLGGEKFPEHADEWAKSVESSTSSVSTAWSAYGSLRPPQNAWQRSKRTMARTVRSGRRRSASPCSDCPAK

SEQ ID NO: 579 - protein, 410 aa, Asplenium nidus var plicatum
MRSTSNTQRFQRTSDQVFRELGTTFSLSFPIKVLRLSFGATFRSIASSQTNVASALILVESYSRRLLILNEQRSIQLIPLRADFLQELRNLPEPPTSITAASQWVSYRDFLLRWGSHYASEVYYGSWLRTWATAASTKSYTQRQITAKGCADLTGSSRIPIIGGCRDIAISEMTAASRLDINVQIEIRGGESGTRAELAVRRTDRLIQDFIREGQVNDEADVKYGLAPIWRPVLARYHSATSKEWRVATALEAYYNGFLSFPCPYNIENGIVLQQFRRITTGTYRCVRPCQGCRDFHDCNLRQFGCYCYGSTCIAAGGDDNRAWIQRWFTGSRYYPPSSSCYYQFPSCRCNYGWREANCGTDRTITIWDQTKVNVGVHGNETVVEALSIENNVWVSPANSSNIAEAMSFE

SEQ ID NO: 580 - protein, 252 aa, Huperzia carriata (Solomon Islands)
MGEVLVGCRGNYVATTKISEFSSYTKISIVAESSFKSVAGMKVSAEQKQLIEKFQENSSTSLYAIGGSALSSITDTATYNKWLSSIDTRPVFCGFTRDSLRPIWELAESPQRREILRKATQTFIPPEITRNAIVGVDIIMSDNYWVNPPYGYTKIDYDLNRNAKGKYIFLCYKQQKISVAGSPADPKPITALYVASGDDDNPYVPAGYTKIDKDLNKDAGGKFIYLCYTKDPAAIPNDEDGLPHTWHPRYRQ

SEQ ID NO: 581 - protein, 268 aa, Huperzia nummulariifolia
MNSEELFTTYGTHYLSEVLVGGRADYVATTKTSAFSSDTEISLAAESSFKSMAGMENSSEYKELIQKFQENSSTRPYAIGGTRTLQHKDTATYNAWLSSIDTLPVFCGFTSASLRPIWELAESSQRQEILQKATKTFISPEIKRNAIVDVDIIVSDNYVVNPNYGFTKIDYDLNCGAGGKYIFLCYKQQKISIAGSAADPKPITALYVATGDNDKPSVPAGYTKINRDLNDGAGGKYIYLCYTKDPAASRWTASYVASALLVTKISTM

SEQ ID NO: 582 - protein, 329 aa, Selaginella victoriae
MKVEGKYNFFSAEVEASIGMSSAQNLQNEFVQLQQTVSYYNLQLPVNHKDLLKPSVKDDIDNIENTAELFDRYGTHYLAGIIMGGSAMYTSTTNKMSFESSTELDVVAKMSYDELVGSISAEDRTKYEQKIKNFRESSTTELHNKGGDPGLSGQNFPANAEEWNKSVIDYLAFCEFLSSDQSLLGIWELASTPARSKQIQDSYHDYCRDKQTKYNVDPPYLQAKIVPLKRVQFTDTGSHAHDYLTVCIPDVDSGWYYLGQVAFPGGGARGSTIVVKELVAGALIDVKWWQWVWDDSGSHNSKDFSLWYGNSANPVEYYVLGDFFRGALL

SEQ ID NO: 583 - protein, 488 aa, Selaginella pallescens
MSYTSSIVFSFVLAALLFYPFCVQSSNVHIGNGLYLPDTNLMVPINSQYTIFEGDISRFLREEPLGITFNNKVFSRDTESLYREFSQTFGLNAQYRVVQISVDLGITFNNKVFSRDTESLYREFSQTFGLNAQYRVVQISVEQSLQHIAGSETNVTALSIDVLTYSKKLSIRNEARTITRIPLREAFLQELRQLPEYPADGDNNWLPYLRFMRKWGSHYVNAVYYGSWFQQWSTASSTMRFTERQFQARACVAVEGVGNKFPSVEACAGVGEQEKRAASSLSMRTRLVVRGGEPRTASMLSSGQRTDELLQQFIEEGLDSTVAVRYEFTPLWTQVLADYGMNTREGRIASAMEAYYEGFLAFGCPRMTTTNNIAMQRFRRSVSNLYSCERKCEGCSVAADCNRIGNSQICKCFGNSCIRLIEDNPEDRVEVQTTRDDLRQNEGPNRSCQFSGSSCRCVASAESNCVAGYRAIWNQWDALAEKDAVQVM

SEQ ID NO: 584 - protein, 300 aa, Huperzia nummarifolia
MEQIEPLPGSDAIGHSYDVFGFFANPKSVKSQLFDFAPQEEITLEGHNWLLSTDIEYTAVRDTQIETVSYLTKDAYSRELAASVKVSGSYGGFSASVESDFSQSISNESDSTYTSVRTNVNKWKLSLNPTVKELRSMLTPSFKEALASMNSEELFTTYGTYYLSEVLVGGRADYVATTKTSAFSSDTEISLAAESSFKSMAGMENSSEYKELIQKFQENSSILLYAIGGTALSSITDNDTYNAWLNAWLSSIDTLPVFCGFTSASLLPIWELAESSQRQDILQKATQTFIPLEVRRNAIV

SEQ ID NO: 585 - protein, 368 aa, Selaginella kraussiana (Variegata)
MAEHSEQKGSLILESLEEGRKLPGTEILGSGYDVLGGYYADPRSCLVNLFDFPAEVETVQIGNQEFSKSTGIVYHSSIGTDLDMSSGKSIQEYTKEINSKTKLEGNYSFFSASIEADIGIKSAQKSENEFSKAQYNVKFFTLQLPPHHSKMLKPQIKDDIDNMSDLVRLFDMYGTYYLAGILMGGAASSTSSTSTSTFNSSLDVSVAAKIAFQWSIGGLSAEEQAEYKQQVKSFNESSETTVRTTGGKPGIKFPAEIGEWSDSILDYMAFVDYLGSRSLVGIWELASTRERQDELHKFYHKYCRFRQMQIIPLLRARVVPFAQMSRLGSNLAAWAPDEPDMPFGWYYLGQVWYTRAPTKWSRPSGFEL

SEQ ID NO: 586 - protein, 374 aa, Huperzia goebelii (Holub)
MAEIESLPQSSDYAMDQIEPLPGSDAIGHSYDVFGFYANPKSVNRQLFDFAPQQEITLEDHTWLLSTDIVYIAVRDTDIKTVSYRTKDAYSTELAASVKVSGSYGSFSASVESDFSQSISDETDSTYTSVRTNVNKWKLSLKPTVEELRSMLTPSFKEALASMNSEELFTTYGTHYLSEVLVGGRADYVATTKTSAFSSDIQISVVAESSFKSVAGMDVSSKYKELIQIFQENSSTRLYAIGGTALSSITDTTTYNAWLSSIDTRPVFCGFTRDSLRPIWELAESPQRQEILQKATKTFIPLEIRRNAIVDVDIIVSDNCWANPPYGYTKIDYDLNRNAKGKYIFLCYNQQKISVAGSPADPKPITALYVASGD

SEQ ID NO: 587 - protein, 288 aa, Huperzia nummarifolia
MKVSAEQKQLIEKFQENSSTSLYAIGGSALSSITDTATYNAWLSSIDTRPVFCGFTRDSLRPIWELAESPQRREILRKATQTFIPPEITRNAVVGVDIIMSDNYWVNPPYGSQRREILQKATETFIPPEITRNAVVGVDIIMSDNYWVNPPYGYTKIDYDLNRNAKGKYIFLCYKQQKISVAGSPADPKPITALYVTSGDDYNPYVPPGYTKIDKDLNMNSGGKYIFLCYTKDPAASKDGLPIRGIRVIGNEKLENVVTPYGYTRIDQDLNKGAGGDYIFVCFSRYVD

SEQ ID NO: 588 - protein, 451 aa, Huperzia squarrosa
MAQIEPLPGSDAIGHSYDVFGFYANPKSVKKELFDFALQKEITSEGHTWLLSTDIEYIAVRDTEIKTVSIRTKDAYSSELAASVKLCGSYGGFSASVESDFSESISDETDSTYTSVRTNVNKWKLSLKHTVEELRSKLKPALKEALASMKAVELLSTYGTHYMAEVLVGGRADYVATTKNSAFSSDTKISIVAESSFKSVAGMKVSAEQKQLIEKFQENSSTSLYAIGGSALSSITNTATYNAWLSSIDTRPVFCGFTRDSLRPIWELAESPRRREILRTATQTFIPSGITRNAIVGVDIIVSDNYSVNPPYGYTRRSYDLNRNAKGKYIFLCYKQQKISVAGSPADPTPITALYVASGDDDNPYVPPGYTKIDKDLNKDHGGKFIYLCYTKDPAAIPNDEDGLPIRGIRVIGSKKVENVVTPYGYTRIEEDLNKGAGGDFIFICFSRHLD

SEQ ID NO: 589 - protein, 373 aa, Huperzia phlegmaria
MAQIESLPQSSDYAMDQIEPLPGSDAIGHSYDVFGFYANPKSVKKELFDFALQKEITLEGHTWLLSTDIVHIAVRDTDINTVSLRTKDAYSTELAASVKVSGSYGSFSASVESDFSQSISDETDSTYTSVRTNVNKWKLSLKPTVEELRSMLTPSFKEALASMNSEELFTTYGTHYLSEVLVGGRADYVATTKTSAFSSDTKISVVAESSFKSVAGMEVSAEYKELIKKFQENSSTRLYALGGSALSSITDTASYNAWFSSIDTRPVFCGFTRDSLRPIWELAESPQRREILRKAAQTFIPPEITRNAIVGVDIIMSDNYWVNPPYGYTKIDYDLNRNAKGKYIFLCYNQQKIFVGIPCGSDAHHCLVRGFWR

SEQ ID NO: 590 - protein, 319 aa, Huperzia nummulariifolia (Blume)
MLKPSFKEALASMNSEELFTTYGTHYLSEVLVGGRADYVATTQTSAFSSDIQISVVAESSFKSVAGMDVSSKYKELIQIFQENSFTSLYAIGGSALSSITDTDTYNAWLSSIDTLPVFCGFTCETDTYNAWLSSIDTLPVFCGFTCESLQPIWELAESPQRQEILQKATQTFIPLEIKRNAIVDVDIVVSDNHKVNPPYGFTKVDYDLNNNANGKYIYLCYKQQKISVAGSPADPKPITALDVASGDDDDPDVPPGYTRINSDLNEGAGGKYIYLCYTKDPAAIPSDEDGLPILASALLVTKNSRMWLHLTDSRRLIKI

SEQ ID NO: 591 - protein, 451 aa, Huperzia carriata (Solomon Islands)
MAEIKPLPGSDSIGHSYDVFGFFANLKSVKRQLFDFAPQEEITLEGHNWLLSADIEYTAARDTEIKTISDRTTDAYSTELAASVKVSGSYGYFSASVESDFSQSISDETDSTYTSVRTNVTKWKLNLKPTVEELRSMLTPSFKEALASMDSDELFTTYGTYYLSEVLVGGRADYVATTKTSAFSSDTQIGVVAESSFKSVAGMEVSSQYKELIKKFQENSSTSLYAIGGSAISSITDTATYNKWLSSIDTLPVFCGFTSASLMPIWELAESSERQEILQKATKTFIPPEIRQNAIVDVDIIVSDDSSVNPPDGYTKIDYDLNHNAKGKYIFLCYNQQKISVAGSPADPKPITALYVASGDNNNPYVPPGYTMINRDLNAGAGGNFIYLCYTKDPAEIPSDEDGLPIRGIRVIGNAKFVNVITPYGFTRIDKDLNEGAKGDFIFVCFSRHLD

SEQ ID NO: 592 - protein, 324 aa, Platycerium bifurcatum
MQSDTVMMYSDFTPTPRALIHTSSTLRSRKKSFLRATPVSTDIEYIAVRDTEIKTVSLRTKDAYSSKLAASVKLSGTYGAFSASVEADFSKNISDETDSTYTSVRINVNKWKLSLKHSVEKLRSLLKPALKEALSSMNALELFSMYGTHYMGEVLVGGRADFVATTKTSAFSSETKISAVAESSFNSMAGVKVSAAQKQLINKFQENSSTSLYAIGGSALINKFQENSSTSLYAIGGTALSSITDTTTYTAWLRSIDTNPVFCGFSSDSLRPIWELAEFPLRRGSLNPLSAGRFSEKLQKRLSHAESHEMQSLTWILSRQTIIG

SEQ ID NO: 593 - protein, 315 aa, Huperzia goebelii (Holub)
MLTPSFKEALASMNSEELFTTYGTHYLSEVLVGGRADYVATTKTSAFSSDIQISVVAESSFKSVAGMDVSSKYKELIQIFQENSSTRLYAIGGTALSSITDTTTYNAWLSSIDTRPVFCGFTRDSLRPIWELAESPQRQEILQKATKTFIPLEIRRNAIVDVDIIVSDNCWANPPYGYTKIDYDLNRNAKGKYIFLCYKQQKISVAGSSADPKPITALYVASGDNDNPYIPSGYTKINKDLNEGAKGKFICLCYTKDPAAIPNYQDGLPIRGIRVIGNEKVENVVTPYGFTKINTDLNDGAGGDYIFVCFSRHLD

SEQ ID NO: 594 - protein, 449 aa, Selaginella kraussiana (Variegata)
MSYTSSIVFSFVLAALLFYPFCVQSSNVHIGNGLYLPDTNLMVPINSQYTIFEGDISRFLREEPLGITFNNKVFSRDTESLYSEFSQTFGLNAQYRVVRISVEQSLQHIAGSETNVTALSIDVLTYSKKLSIRNEARTITRIPLREAFLQELRQLPEYPADGDSNWLPYLRFMRKWGSHYVNAVYYGSWFQQWSTASSTMRFTERQFQARACVAVEGVGNKFPSVEACAGVGEQEKRAASSLSMRTRLVVRGGEPRTASMLSSGQRTDELLQQFIKEGLDSTVAVRYQFTPLWTQVLAVYGMNTREGRIASAMEAYYEGFLAFGCPRMTTTNNIAMQRFRRSVSNLYSCERKCEGCSVAADCNRIGNSRICNCFGNSCIRLIEGNPEGRVEVQTTRDDLRQNEGPNRSCQFSGSSCRCVASAESNCVAGYRAIWNQWDALAEKDAVQVM

SEQ ID NO: 595 - protein, 503 aa, Adiantum raddianum (Gracillimum)
MGTCRNRRRTEEDMSVRAGVRDIHYITVQVASMQMQIQAAAIAMTSPVVATIFRTLLVVFCFCAPGSAIGQQQPLVYIGATVYLPGTNLGSAITPLRGIFEGNISRFLVEENYTTVLNTMKFHSSSDSMVRELSTTFGLSGSPTKAVELSLETSLKSLKGSQTNVTSSLAVVESYSKRVFLRNERERAVETIPLRTDFLQELRNLPILPSPTSDDGWGPYRSFLTKWGSHYISTIYSGSWLRQWSVAASSQRYSQRQIEAKACAKLTGVATIPSIQGCAGFSTNEMMSSLNLQTNDEIEVRGGQAATAAAIVTGRTDALVRQFIEEGRTSNVPVRYGFLPIWRPVLDTYTSPSSKEWQVATALEAYFNGFLAFECPRKFLSSRSVILQQFRRKQNGFYECVRTCVGCKSNYDCTLNSAACYCYGESCVIAQPPDGRPQIQRYKDNLSTWDLPNLSCYYSFPYCVCDTKSQEPNCGQDGFIPIWSQDKDSSALSSTTSMDSDVI

SEQ ID NO: 596 - protein, 318 aa, Platycerium bifurcatum
MALIEPLPGSDAIGHSYDVFGFYANPKSVNTQLFDFAPQQEIILEDHKWLLSTDIEYIAVRETEIKTVSLRTKDAYSTELAASVKVSGSYGSFSASVESDFSQSISDETDSTYTSVRTNVNKWKLSLKPTVEELRSMLTPSFKEALASMDSEELFTTYGTHYLSEVLVGGRADYVATTKTSAFSSDIQISVVAECSFKSVAGMEVSSQYKELIKTFQENSSTRLYAIGGTTISSITDKDTYNAWLSSIDTRPVFCGFTYESLQPIWELAESPQRQEILQKATSDSLRPIWELAEFPLRREILRKATQTLIPHEMQLLA

SEQ ID NO: 597 - protein, 303 aa, Platycerium bifurcatum
MNALELFSMYGTHYMGEVLVGGRADFVATTKTSAFSSETKISAVAESSFNSMAGVKVSAAQKQLINKFQENSSTSLYAIGGTAISSITDTDTYNAWLSSIDTCPVFCGFTYESLQPIWELAESPQRQEILQKATKTFISPEIKRNAIVDVDIIVSDNYGVNPPFVLQATEDDLNRNAKGKFIFLCYNQQKISVAGSPADPKPITALYVASGDDDHPYVPPGYTRISSDLNEGAGGKFIYLCYTKDPAAIPSDEDGLPIRGIRVIGNENIDNVVTPYGFTKIDKDLNEGAGGDFIYVCFSRHLD

SEQ ID NO: 598 - protein, 463 aa, Huperzia carinata
MAQIEPLPGSDAMAQIEPLPGSDAIGHSYDVFGFYANPKSVKRELFDFAPQQEITEEGHTWLLSTDIVNTAVRDTEIKTVSLRTKDEYSTELAASVKVSGSYGGFSASVESDFSQSISQETDSTYTSVRTNVTKWKLGLKPTVEELRSMLTPSFKEALASMESEELFTTYGTYYLSEVLVGGRADYVATTKTSAFSSDTQISVVAESSFKSVAGMEVSSQYKELIKKFQENSSTRLYAIGGTALSSITDTATYNAWLSSIDTLPVFCGFTSASLKPIWELAESSQRQEILQKAAQTFIPLEIRRNAIVDVAIIVSDNHLVNPPYGFTKIDFDLNRGAKGKFIYLCYKQQKISVAGSPADPKPITALNVVSSDYHDPSAPSGYTMINTDLNQGAKGKFIYLCYTKDPAAIPSDEDGLPIRGLRVIGNPQVENVVTPYGFTRINKDLNEGAKGEYIYVCFSRHLD

SEQ ID NO: 599 - protein, 578 aa, Selaginella biformis
MADSPLVSVNLRAAVRENGYRMLKSPVFKEQHLERLWKSIDPHYKQKQLWASDSGTPLGDHDDNLESLPGCNIVGCGYNVLHGYYADARSCLQDLFDLESSGMSKVSVGAKEFAKPNVVIMRPKYATSTYVETGKTIEQYNSSISSVGAKEFAKPNVVIMRPKYATSTYVETGKTIEQYNSSISSKTQLQGEYNFFSASVEVDIGINQAENLQNEFTKVQSDVETFVLQLDVGHEKMLKPQVKKDIDEMKDLDNLYDTYGTHYLRTIVMGGHATYTSSTNKNEFSSEFELGVVASMSFKALVGSISASEEAKYTSSIQSFNESSTTKIETSGGDPGLGGTYFAKHVDEWINSVKDYMTLADFVHGETVPLWRLASTAEREDALQKHYLDYCKRKQTTYTLSGIPPLRVRRVPVTEGFQPYYHVGTPDIGGNWSYFGQTNGYGYTIVVQETQPGSGVLGRIAKWEKIGDVYGCSVWRGVPADPVDYVVLSDFTHRGSNAPTAEETVGIMAVHRSCLISIGSGSGLDNPSWDFCMWGVDPVYNPKVSLLEDLKLYVMVIFSGQGTREMYRLLASELQVED

SEQ ID NO: 600 - protein, 448 aa, Huperzia tetratoides
MAHIEPLPGSDAIGHSYDVFGFYANPKSVQRQLFDFAPQQEITSEGHAWLLSTDIESIAVRDTEIKTVSLRTKDEYSRELAASVKVNGSYGGFSASVESDFSQSIAQETDSTYTSVRTNVNKWKLSVKPTVEELRSMLTPSFKEALASTDPVELFTTYGTHYLIEVLVGGRADYVATTKTSAFSSDTQLSAAAEMSFKSVAGMEVSAQDKELIKKFQENSSTRLYAIGGTALSSITDTATYDAWLSSIDTRPVFCGFTTDSLKPIWELAESPERREVLQKATETFIPPEITRNAIVGVDIVVSDNDAVNPPYGYTKINYDLNSNAKGKYIFLCYKQQKISVAGSPADPKPITALYVASGDNNHPSIPSGYTKINVDLNQGSGGKYIYLCYTKDPASDEDGLPIRGIRVIGSPNSGDVVTPYGFTRINKDLNEGAKGDFIYVCFSRHLD

SEQ ID NO: 601 - protein, 262 aa, Huperzia carinata
MAQIEPLPGSDAMAQIEPLPGSDAIGHSYDVFGFYANPKSVKRELFDFAPQQEITEEGHTWLLSTDIVNTAVRDTEIKTVSLRTKDEYSTELAASVKVSGSYGGFSASVESDFSQSISQETDSTYTSVRTNVTKWKLGLKPTVEELRSMLTPSFKEALASMESEELFTTYGTYYLSEVLVGGRADYVATTKISEFSSYTKISIVAESSFKSVAGMKVSAEQKQLIENFQENSSTSLYAIGGSALSSIKILPLTTHGSVTPFD

SEQ ID NO: 602 - protein, 294 aa, Huperzia salvinioides
MARIEPLPGSDAIGHSYDVFGFYANPKSVKKELFDFALQKEITLEGHIWLLSTDIEYIAVRDTEIKTVSLRTKDAYSSELAASVKLSGSYGGFSASVETDFSQSISDETDSTYTSVRTNMNKWKLSEAQCGKAALPVEACVEGGIGEYESSGAVEYLRDNYMGEVLVGGRGDYVATTKTSAFSSDTKISIVAESSFKSVAGMKVSAEQKQLIEKFQENRSTSLYAIGGTALSSITDTATYNAWLTSIDTRPVFCGFTRESLQPIWELAESPQRREVLRKAAQTYIPPHEMPSLA

SEQ ID NO: 603 - protein, 451 aa, Huperzia carinata
MACIEPLPGSDAIGHSYDVFGFYANPKSVKRELFDFAPQQEITEEGHTWLLSTDIVNTAVRDTEIKTVSLRTKDEYSTELAASVKVSGSYGGFSASVESDFSQSISQETDSTYTSVRTNVTKWKLGLKPTVEELRSMLTPSFKEALASMESEELFTTYGTYYLSEVLVGGRADYVATTKTSAFSSDTQISVVAESSFKSVAGMEVSSQYKELIKKFQENSSTRLYAIGGTALSSITDTATYNAWLSSIDTLPVFCGFTSASLKPIWELAESSQRQEILQKAAQTFIPLEIRRNAIVDVAIIVSDNHLVNPPYGFTKIDFDLNRGAKGKFIYLCYKQQKISVAGSPTDPKPITDLYVASGDNKDPSVPRGYTKINRDLNDGAGGKYIYLCYTKDPAEIPDDEDGLPIRGIRVIGKTKAIDVITPYGFTRIDTDLNDGAGGDYIFVCFSRHLD

SEQ ID NO: 604 - protein, 257 aa, Platycerium bifurcatum
MLTPSFKEALASMDSEELFTTYGTHYLSEVLVGGRADYVATTKTSAFSSDIQISVVAECSFKSVAGMEVSSQYKELIKTFQENSSTSLYAIGGTTISSITDKDTYNAWLSSIDTRPVFCGFTYESLQPIWELAESPQRQEILQKATKTFISPEIKRNAIVDVDIIVSDNYGVNPPYGYTKIDYDLSPEIKRNAIVDVDIIVSDNYGVNPPYGYTKIDYDLNRNAKIYLFVLQSTEDISSRIPCGSEAHHCFVRGFWR

SEQ ID NO: 605 - protein, 503 aa, Selaginella pallescens
MAEHSEQKGSLILESLEEGRKLPGTEILGSGYDVLGGYYADPRSCLVNLFDFPAEVETVQIGNQEFSKSTGIVYHSSIGTDLDMSSGKSIQEYTKEINSKTKLEGNYSFFSASIEADIGIKSAQKSENEFSKAQYNVKFFTLQLPPHHSKMLKPQIKDDIDNMSDLVRLFDMYGTYYLAGILMGGAASSTSSTSTSTFNSSLDVSVAAKIAFQWSIGGLSAEEQAEYKQQVKSFNESSETTVRTTGGKPGIKFPAEIGEWSDSILDYMAFVDYLGSRSLVGIWELASTRERQDELHKFYHKYCRFRQMQIIPLLRARVVPFAQMSRLGSNLAAWAPDEPDMPFGWYYLGQVWYHTGPYKMVPAVFALIVQEMEPGMLADVRSWSKVGDGPEGSSFWHGSSASEDHLVLGNFFHDKSNPPTALESFGIKAVHMDCLVPANLGYYHNMPGSDVLLGLKVWPVVAADDTAIPMDKLQSCFSLDGPGPFYLLKKSAVELDRGWWVLE

SEQ ID NO: 606 - protein, 528 aa, Selaginella victoriae
MDLDAAPMDQHTLPGCEILGSGYDVLNGYYADSRSCLTNLFDFPANYETVKVGSQSFTKPVEISYHSSTGTNLYTDAGNTITEFESSINSRTQIEGSYTFFSSSIDVEIGESSAKSIDNAFSKVNYRVDQYTLQLPPKASEYLKKYVQEDIDKMTDLTRLFDTYGTHYLAKLIMGGVANYSATTKKSKFTSNYDLKVVATMSYKSAVGSLSVSEENTYKQSISSFNQSSTISLKTKGGDPGLGGEKFPEHADEWAKSVENYLSFIDFLGVNSLVGIWELASTAKRMAEIKAYYGTYCEIRQKHYFLDDGPLLRARIVQLSKVQFTDAGSGAKRDLSVCIPDIGGGWYYLGQVALPGGGATGNTLVIQEKYPGSGVLLDVDHWEKVWDDHGSKKPKDYSLWRGVAANPVDYVVLSDFFRGGVSSQYEPTAEETVGIKAVAGACVVRGKVGEMVWNDEKSKASDDGSVWSIVPADNTAINTSSIKPYYVSEKSHKSPSGACVVRGKVGEMVWNDATMDPFGALFQRITRP

SEQ ID NO: 607 - protein, 315 aa, Huperzia carriata (Solomon Islands)
MLTPLFKEDLASMNSEELFTTYGTHYLSDVLVGGRTDYVATTKTSRFSSDSEISVAAESAFKSVAGMEVSSQYKELIKKFQENSSTSLYAIGGSAISSITDTATYNKWLSSIDTLPVFCGFTSASLMPIWELAESPQRQEILKKATQTFIPLEIRRNAIVEVAIIVSSDHQVKPLYGFTKIDFDLNSGAKGKFIYLCYKQQKISVAGSPADPKPITALYVASGDNNNPYVPPGYTMINRDLNAGAGGNFIYLCYTKDPAEIPSDEDGLPIRGIRVIGNAKFVNVITPYGFTRIDKDLNEGAKGDFIFVCFSRHLD

SEQ ID NO: 608 - protein, 315 aa, Huperzia carriata (Solomon Islands)
MLTPSFKEALASMDSDELFTTYGTYYLSEVLVGGRADYVATTKTSAFSSDTQIGVVAESSFKSVAGMEVSSQYKELIKKFQENSSTSLYAIGGSAISSITDTATYNKWLSSIDTLPVFCGFTSASLMPIWELAESPQRQEILKKATQTFIPLEIRRNAIVEVAIIVSSDHQVKPLYGFTKIDFDLNSGAKGKFIYLCYKQQKISVAGSPADPKPITALYVASGDNNNPYVPPGYTMINRDLNAGAGGNFIYLCYTKDPAEIPSDEDGLPIRGIRVIGNEKVENVVTPYGFTKIDKDLNEGAGGDFIFVCFSRHLD

SEQ ID NO: 609 - protein, 415 aa, Selaginella victoriae
MVDRAEFMQSSTQVFQFFGISFGMSFPIKKLMFSFDTSFQAISGGRQEIKAAVLQVESYSRRSFFRNNLALQLNPTLVQDLNSLPEPPTITAHRHDWRNHENFLRKWGSHYMTEVRYGSWMRQFTSAASTETYSEIEMKANACARLFGGKLSKIGACAGITQQQINANSNLRVRLTTEVRGGNAQTAAQLRRIPVQESVIESFKVEGRNSNEAVVYHFAPIWQAIKARYSVQTRQWRQADALESFYVGFLAFDCPQRILNTGSSSEPTTLLQQFRRRGEKFQCVRHCVGCRRSKDCNFHTTGNGAPGCYCYGNSCLVAQGAESRIAIQTRRDNLPRNVNPNRSCQQSGVSGCKCDRNPRENGCGADNMIEIWPQTPRNPNPGTLNAYEETGVDIVDDMIMVQEDEVVYDEMKNIM

SEQ ID NO: 610 - protein, 444 aa, Platycerium bifurcatum
MQSDTVMMYSDFTPTPRALIHTSSTLRSRKKSFLRATPVSTDIEYIAVRDTEIKTVSLRTKDAYSSKLAASVKLSGSYGSFSASVESDFSQSISDETDFTYTSVRTNVNKWKLSLKPTVEELRSMLTPSFKEALASMDSEELFTTYGTHYLSEVLVGGRADYVATTKTSAFSSDIQISVVAECSFKSVAGMDVSAKYKELIQKFQENSSTSLYAIGGTAISSITDTDTYNAWLSSIDTCPVFCGFTYESLQPIWELAESPQRQEILQKATKTFISPEIKRNAIVDVDIIVSDNYGVNPPFVLQATEDDLNRNAKGKFIFLCYNQQKISVAGSPADPKPITALYVASGDEPITALNVVSSDYHDPSGPSGYTMIYTDLNQGVGGKFIYLCYTKRSSIRSSRLYQDQQRSERGCGGQIYLSMLHKRSGCNTQRRGWTAHTWHPRYW

SEQ ID NO: 611 - protein, 251 aa, Huperzia carinata
MAGMESSSEYKELIQKFQENSSTRLYAIGGTALSSITDTATYNAWLSSIDTLPVFCGFTSASLKPIWELAESSQRQEILQKAAQTFIPLEIRRNAIVDVAIIVSDNHLVNPPYGFTKIDFDLNRGAKGKFIYLCYKQQKISVAGSPTDPKPITDLYVASGDDDNPYVPAGYTKIDKDLNKDAGGKFIYLCYTKDPAAIPSDEDGLPIRGLRVIGNPQVENVVTPYGFTRINKDLNEGAKGEYIYVCFSRRQ

SEQ ID NO: 612 - protein, 423 aa, Huperzia carinata
MAQIEPLPGSDAIGHSYDVFGFYANPKSVKRELFDFAPQQEITEEGHTWLLSTDIVNTAVRDTEIKTVSLRTKDEYSTELAASVKVSGSYGGFSASVESDFSQSISQETDSTYTSVRTNVTKWKLGLKPTVEELRSMLTPSFKEALASMESEELFTTYGTYYLSEVLVGGRADYVATTKTSAFSSDTQISVVAESSFKSVAGMEVSSQYKELIKKFQENSSTRLYAIGGTALSSITDTATYNAWLSSIDTLPVFCGFTSASLKPIWELAESSQRQEILQKAAQTFIPLEIRRNAIVDVAIIVSDNHLVNPPYGFTKIDFDLNRGAKGKFIYLCYKQQKISVAGSPADPKPITALNVVSSDYHDPSAPSGYTMINTDLNQGAKGKFIYLCYTKDPAASLLHKRSGCNTQRRGWTAHTWHPRYRQ

SEQ ID NO: 613 - protein, 450 aa, Selaginella victoriae
MVSHSSLVLWCSFLVLAYYIGYTSCVQNLGHGVYLPDTNLVSNSNPNAPQLIFRENVADFVTNESFSRMVDRAEFMQSSTQVFQFFGISFGMSFPIKKLMFSFDTSFQAISGGRQEIKAAVLQVESYSRRSFFRNNLALQLNPTLVQDLNSLPEPPTITAHRHDWRNHENFLRKWGSHYMTEVRYGSWMRQFTSAASTETYSEIEMKANACARLFGGKLSKIGACAGITQQQINANSNLRVRLTTEVRGGNAQTAAQLRRIPVQESVIESFKVEGRNSNEAVVYHFAPIWQAIKARYSVQTRQWRQADALESFYVGFLAFDCPQRILNTGSSSEPTTLLQQFRRRGEKFQCVRHCVGCRRSKDCNFHTTGNGAPGCYCYGNSCLVAQGAESRIAIQTRRDNLPRNVNPNRSCQQSGVSGCKCDRNPRENGCGADNMIEIWPQTPRNPNPE

SEQ ID NO: 614 - protein, 409 aa, Selaginella pallescens
MVPINSQYTIFEGDISRFLREEPLGITFNNKVFSRDTESLYREFSQTFGLNAQYRVVQISVEQSLQHIAGSETNVTALSIDVLTYSKKLSIRNEARTITRIPLREAFLQELRQLPEYPADGDNNWLPYLRFMRKWGSHYVNAVYYGSWFQQWSTASSTMRFTERQFQARACVAVEGVGNKFPSVEACAGVGEQEKRAASSLSMRTRLVVRGGEPRTASMLSSGQRTDELLQQFIEEGLDSTVAVRYEFTPLWTQVLADYGMNTREGRIASAMEAYYEGFLAFGCPRMTTTNNIAMQRFRRSVSNLYSCERKCEGCSVAADCNRIGNSQICKCFGNSCIRLIEDNPEDRVEVQTTRDDLRQNEGPNRSCQFSGSSCRCVASAESNCVAGYRAIWNQWDALAEKDAVHAIG

SEQ ID NO: 615 - protein, 417 aa, Platycerium bifurcatum
MALIEPLPGSDAIGHSYDVFGFYANPKSVNTQLFDFAPQQEIILEDHKWLLSTDIEYIAVRETEIKTVSLRTKDAYSTELAASVKVSGSYGSFSASVESDFSQSISDETDSTYTSGFSASVESDFSQSISDETDSTYTSVRTNVNKWKLSLKPTVEELRSMLTPSFKEALASMDSEELFTTYGTHYLSEVLVGGRADYVATTKTSAFSSDIQISVVAECSFKSVAGMEVSSQYKELIKTFQENSSTRLYAIGGTTISSITDKDTYNAWLSSIDTRPVFCGFTYESLQPIWELAESPQRQEILQKATKTFISPEIKRNAIVDVDIIVSDNYGVNPPYGYTKIDYDLSPEIKRNAIVDVDIIVSDNYGVNPPYGYTKIDYDLNRNAKGKYIFLCYTEDISSRIPCGSEAHHCFVRGFWR

SEQ ID NO: 616 - protein, 258 aa, Huperzia goebelii (Holub)
MAQIEPLPGSDAIGHSYDVFGFFANPKSVKRQLFNFASQEEITLEGHSWLLSTDIEYTAVRDTDIKTVSYRTKDAYSTELAASVKVSGSYGSFSASVESDFSQSISDETDSTYTSVRTNVNKWKLSLKPTVGELRSLLTPSFKEALASMDAEELFTTYGTHYLSEVLVGGRADYVATTKTSAFSSDTEIKLAAESSFKSMAGMGNSSQYKELIQKFQENSSILLYAIGGTALSSITDTTTYNAWLSSIDTRPVFCGFT

SEQ ID NO: 617 - protein, 597 aa, Selaginella kraussiana (Variegata)
MVISGAETKAVAAIQALGCGFDVTLDHKLEYAKSRLVDLDPETRTVVVPGNIIVEDVSMDIKVDKGENTRLRTDALDFHQMSERFNQGCGIAGKMPLGLLTAMYDLKGPWQLDALSTKCLAFDGYIAVLYEMKVAKSLISLLREVKDAVPSNWQPLELTRFIEKYGTHVITGVKVGGKDVIYLRQSQSSKLSAVDIQRYLESLAEQRFADGSGRRFKVFKKGAKTKVADPFAMIDRSKVINNFSSISISDDNVEVKFKRRGGLDSIRDHGPWLLSVPNAPEVVSMSFVPITSLLAGVPGTGFLTHAINLYLRYKPPIDELQFFLEYQVPRQWSPTLDASNQTSSSNLPALQFSPMGPKLHVSTDEATAGKRPVTGLRLYIQGKKLNRLTIHLQHLSSLPKILESHWGASNTYNDAPQWKSCEDEPRWLEPVQWKSFSHVNTAPVEYVEQCIGDETGDFIVTGAQLEVSDSRTRPVLSLRLQFTRVPGCSIRRSVWDNMPAMQKSSSGFFSQFGFSNVSNAQHKQQQSQQQRFVQNSAVFSGGPSRSVHGSRLLKFVDVSEMSKGVQDEPGHWIVTGGKLDVEGGKICLKVKYSLLKY

SEQ ID NO: 618 - protein, 410 aa, Asplenium nidus var plicatum
MRSTSNTQRFQRTSDQVFRELGTTFSLSFPIKVLRLSFGATFRSIASSQTNVASALILVESYSRRLLILNEQRSIQQIPLRADFLQELRNLPEPPTSITAAAQWASYRQFLLRWGSHYASEVYYGSWLRTWATAASTKSYTQRQITAKGCADLTGSSRIPIIGGCRDIAISEMTAASRLDINVQIEIRGGESGTRAELAVRRTDRLIQDFIREGQVNDEADVKYGLAPIWRPVLARYHSATSKEWRVATALEAYYNGFLSFPCPYNIENGIVLQQFRRITTGTYRCVRPCQGCRDFHDCNLRQFGCYCYGSTCIAAGGDDNRAWIQRWFTGSRYYPPSSSCYYQFPSCRCNYGWREANCGTDRTITIWDQTKVNVGVHGNETVVEALSIENNVWVSPANSSNIAEAMSFE

SEQ ID NO: 619 - protein, 354 aa, Ophioglossum pendulum
MEPNKGGVPPMKNVAKPSTKRLIPSSIAASSQTSANALTEPLPGSDAIGQSYDAFGFFANPRSIMKELFEFSPQEEIVVEGNTWLLSSDFVYTAIRDTETSTVSRRTKDDYSKELAVKVKLSGSYGFFSASVESDFSQSISDVTDTTYTSVRTHVNKWRLSLKDDVGALRSKLLPGVKQALATMDATQLFDTFGTHYVSEVLVGGRADYVATTKTSAFSSSTSISVAAEASFQSIAGGEVSPESKVLAETLRENSSTAVAEASFKSIASGEVSPEYKELVQTLRENSSTRLYALGGSALPNITDPATYNAWLESIDTIPVFCGFTQNSLKPISELADSAQRRTLWPKPPKAIRS

SEQ ID NO: 620 - protein, 262 aa, Polystichum lepidocaulon
MASSSPPFAFMGLLMMLLCAGSNGQDQLVYIGRTLYLPTTNLGDSITPVRGIFEGNLSRFLVEEDYIRITNTQRFQASSQSILAELSTTFGLSGSALKTVELSLETSFRVLTGSEANVTSSVVVVESYSKRTFLRPEVQRSVVTIPLREDFLQELRSLPELASPTPDSEWGSYRNFLLKWGSHYISAIYYGSWLRQWSVAESSRQYSQREIQAKACAKLTGAISIPSIDGCAGFSTEEMNRALSLQTNDVIEVRGGSAQTPS

SEQ ID NO: 621 - protein, 270 aa, Huperzia phlegmaria
MLTPSFKEALASMNSEELFTTYGTHYLSEVLVGGRADYVATTKTSAFSSDTQIGDVAESSFKSVAGMEVSSHYLSEVLVGGRADYVATTKTSAFSSDTKISVVAESSFKSVAGMEVSAEYKELIKKFQENSSTRLYALGGSALSSITDTASYNAWFSSIDTRPVFCGFTHESLQPIWELAESPQRQEILQKATKTFIPPEIRRNAIVDVDIIVSDNYWVNPPYGYTKIDYDLNRNAKGKYIFLCYNQQKIFVGIPCGSDAHHCLVRGFWR

SEQ ID NO: 622 - protein, 310 aa, Selaginella kraussiana (Variegata)
MTDAYEWMKTLPGCDTIGSGYDILNGYYADARSCLENLFDFSSVDNEIVVVSGTQYTKPKVLTYHSSIQTDLHMSEGESIMEYNRSVNMKTKLEGEYNFFSASVELDIGKASAENQENSFSRIQENVSYFTLQLPSSYCDLLIKPRMKKDIDEMTDLTKLFKTYGTHYVSGMIIGGSATYTASTNKTTFKSKLGLGYVAKMSYQALVGGLSAQLESQYGEDIKAFNQASSTKLMAKGGDPAYGGHDFPKHTKTTSPSWTSSATAVSPGSGIWRPRTPVPSRLKATTPSTARRVRRTSIWSPPSSELRSFP

SEQ ID NO: 623 - protein, 286 aa, Platycerium bifurcatum
MALIEPLPGSDAIGHSYDVFGFYANPKSVNTQLFDFAPQQEIILEDHKWLLSTDIEYIAVRETEIKTVSLRTKDAYSTELAASVKVSGSYGSFSASVESDFSQSISDETDSTYTSVRTNVNKWKLSLKPTVEELRSMLTPSFKEALASMDSEELFTTYGTHYLSEVLVGGRADYVATTKTSAFSSDIQISVVAECSFKSVAGMEVSSQYKELIKTFQENSSTRLYAIGGTTISSITDKDTYNAWLSSIDTRPVFCGFTYESLQPIWELAESPQRQEILQKATSGKS

SEQ ID NO: 624 - protein, 252 aa, Huperzia nummarifolia
MAGVKVSAAQKQLINKFQENSSTRLYAIGGSALSSITDTATYNAWLSSIDTRPVFCGFTRDSLRPIWELAESPQRREILRKATETFIPRGITRNAIVDVDIITSDNYWVNPPYGYKKIDYDLNRNAKGKYIFLCYKQQKISVAGSPADPKPITALYVTSGDDYNPYVPPGYTKIDKDLNKDAGGKFIYLCYTKDPAAIPNDEDGLPIRGIRVIGNEKLENVVTPYGFTRIDKDLNKDAKGDYIFVCFSRHLD

SEQ ID NO: 625 - protein, 275 aa, Polystichum lepidocaulon
MASSSPPFAFMGLLMMLLCAGSNGQDQLVYIGRTLYLPTTNLGDSITPVRGIFEGNLSRFLVEEDYIRITNTQRFQASSQSILAELSTTFGLSGSALKTVELSLETSFRVLTGSEANVTSSVVVVESYSKRTFLRPEVQRSVVTIPLREDFLQELRSLPELASPTPDSEWGSYRNFLLKWGSHYISAIYYGSWLRQWSVAESSRQYSQREIQAKACAKLTGAISIPSIDGCAGFSTEEMNRALSLQTNDVIEVRGGSAPAACRCGMSSCPSGGLF

SEQ ID NO: 626 - protein, 450 aa, Selaginella biformis
MASLAVFFFVLFALYACAVAQNVHFGFGVYLPGTDLGSPLRTLRSIFNDANNLLVEKYTHAVNNRAHTSNNEQLYKSFGVTFGMSVPVKVLQLNFEASFNKISGSKTSVKTASVFVETYNQKISLRNHARAIQTLQLNPDFLRDLRNLPEPPNSDSAWGPYRSFFNKWGTHYVSETFHGSWLRQWTVASSTETFTERQMQAKACAKLTGLKGIVPNLGGCAGISLEEMRSAERINTQDTREARGGSPATVSQLLSGSVTDDLIRKFIEEGATSKEAVRYGFVPVWMPVLAQYMSSTSKEWRVATALQAYYEGFLAFSCPVNRLNTPSTVLQQFRRLSNGKYQCVRQCQGCRLDKDCNVGTSGASTGCYCYGGSCINALGPDGRAQVQQKKDNLPRNVLPNRSCEYSFPQCRCNTKSKEPNCGADNMIPIWDQDRDTFQSLDSNILLYDEE

SEQ ID NO: 627 - protein, 500 aa, Selaginella victoriae (LW10887)
MDQHTLPGCEILGSGYDVLNGYYADSRSCLTNLFDFPANYETVKVGSQSFTKPVEISYHSSTGTNLYTDAGNTITEFESSINSRTQIEGSYTFFSSSIDVEIGESSAKSIDNAFSKVNYRVDQYTLQLPPKASEYLKKYVQEDIDKMTDLTRLFDTYGTHYLAKLIMGGVANYSATTKKSKFTSNYDLKVVATMSYKSAVGSLSVSEENTYKQSISSFNQSSTISLKTKGGDPGLGGEKFPEHADEWAKSVEYLSFIDFLGVNSLVGIWELASTAKRMAEIKAYYGTYCEIRQKHYFLDDGPLLRARIVQLSKVQFTDAGSGAKRDLSVCIPDIGGGWYYLGQVALPGGGATGNTLVIQEKYPGSGVLLDVDHWEKVWDDHGSKKPKDYSLWRGVAANPVDYVVLSDFFRGGVSSQYEPTAEETVGIKAVAQACVVRGKVGEMVWNDEKSKASDDGSVWSIVPADNTAINTSSIKPYYVSEKSHKSPSRLVYVLKKTAVE

SEQ ID NO: 628 - protein, 337 aa, Huperzia phlegmaria
MARIEPLPGSDAIGHSYDVFGFYANPKSVKKELFDFALQKEITLEGHTWLLSTDIVHIAVRDTDINTVSLRTKDAYSTELAASVKVSGSYGSFSASVESDFSQSISDETDSLSGSYGSFSASVESDFSQSISDETDSTYTSVRTNVNKWKLSLKHTVEELRSKLKPALKEALANMKEVELLSTYGTHYMGEVLVGGRADYVATTKTSAFSSLGTEVEELRSILTPSFKEALASMNSEELFTTYGTHYLSEVLVGGRADYVATTKTSAFSSDTKISVVAESSFKSVAGMEVSAEYKELIKKSTKISTVAESSFKSMAGMKVSATHNQLIQTFQENSST

SEQ ID NO: 629 - protein, 315 aa, Huperzia goebelii (Holub)
MLTPSFKEALASMNSEELFTTYGTHYLSEVLVGGRADYVATTKTSAFSSDIQISVVAESSFKSVAGMDVSSKYKELIQIFQENSSTRLYAIGGTALSSITDTTTYNAWLSSIDTRPVFCGFTRDSLRPIWELAESPQRQEILQKATKTFIPLEIRRNAIVDVDIIVSDNCWANPPYGYTKIDYDLNRNAKGKYIFLCYNQQKISVAGSPADPKPITGLNVVSSDYPNPSVPSGYTMINTDLNQGAGGKFICLCYTKDPAAIPNYQDGLPIRGIRVIGNEKVENVVTPYGFTKINTDLNEGAKGDYIYVCFSRHLD

SEQ ID NO: 630 - protein, 327 aa, Huperzia nummulariifolia (Blume)
MRSKLKSDLKEALASMKVCVEGGIGQYESIGVVESVRNKYMGYRYVFVGGRTGQLYVQGVIGRSCSADYVATTKTSAFSSSTKISTVAESSFKSMAGMKVSATHDQLIQTFQENSSTSLYAIGGSALSSITDTDTYNAWLSSIDTLPVFCGFTCESLQPIWELAESPQRQEILQKATQTFIPLEIRRNAIVEVDIIVSDNHLVNPPYGYTKIDYDLNRNAEGKYIFLCYNQQKISVAGSPADPKPITALDVASGDDDDPDVPPGYTRINSDLNEGAGGKYIYLCYTKDPAAIPSDEDGLPILASALLVTKNSRMWLHLTDSRRLIKI

SEQ ID NO: 631 - protein, 358 aa, Platycerium bifurcatum
MALIEPLPGSDAIGHSYDVFGFYANPKSVNTQLFDFAPQQEIILEDHKWLLSTDIEYIAVRETEIKTVSLRTKDAYSTELAASVKVSGSYGSFSASVESDFSQSISDETDSTYTSVRTNVNKWKLSLKPTVEELRSMLTPSFKEALASMDSEELFTTYGTHYLSEVLVGGRADYVATTKTSAFSSDIQISVVAECSFKSVAGMEVSSQYKELIKTFQENSSTRLYAIGGTTISSITDKDTYNAWLSSIDTRPVFCGFTYESLQPIWELAESPQRQEILQKATKTFISPEIKRNAIVDVDIIVSDNYGVNPPYGYTKIDYDLNRNAKGKYIFLCYTEDISSRIPCGSEAHHCFVRGFWR

SEQ ID NO: 632 - protein, 287 aa, Platycerium bifurcatum
MQSDTVMMYSDFTPTPRALIHTSSTLRSRKKSFLRATPVSTDIEYIAVRDTEIKTVSLRTKDAYSSKLAASVKLSGSYGSFSASVESDFSQSISDETDFTYTSVRTNVNKWKLSLKPTVEELRSMLTPSFKEALASMDSEELFTTYGTHYLSEVLVGGRADYVATTKTSAFSSDIQISVVAECSFKSVAGMDVSAKYKELIQKFQENSSTSLYAIGGTAISSITDTDTYNAWLSSIDTCPVFCGFTYESLQPIWELAESPQRQEILQKATQTFIPLRPKSNEMQSST

SEQ ID NO: 633 - protein, 473 aa, Selaginella victoriae (LW10887)
MDQHTLPGCEILGSGYDVLNGYYADSRSCLTNLFDFPANYETVKVGSQSFTKPVEISYHSSTGTNLYTDAGNTITEFESSINSRTQIEGSYTFFSSSIDVEIGESSAKSIDNAFSKVNYRVDQYTLQLPPKASEYLKKYVQEDIDKMTDLTRLFDTYGTHYLAKLIMGGVANYSATTKKSKFTSNYDLKVVATMSYKSAVGSLSVSEENTYKQSISSFNQSSTISLKTKGGDPGLGGEKFPEHADEWAKSVESFIDFLGVNSLVGIWELASTAKRMAEIKAYYGTYCEIRLRQKHYFLDDGPLLRARIVQLSKVQFTDAGSGAKRDLSVCIPDIGGGWYYLGQVALPGGGATGNTLVIQEKYPGSGVLLDVDHWEKVWDDHGSKKPKDYSLWRGVAANPVDYVVLSDFFRGGVSSQYELLVLRPLPKHVWYVARWVRWYGTMKKARPATMDPFGAYDATMDPFGALFQRITRP

SEQ ID NO: 634 - protein, 290 aa, Huperzia nummulariifolia
MKEVELLSTYGTHYMGEVLVGGRADYVAITKTSAFSSETKISAVAESSFNSMAGVKVSAAQKQLINKFQENSSTRPYAIGGTRTLQHKDTATYNAWLSSIDTVPSSADSLATVLGPSGSSLNPLSAGRFSEKLQKRLSPVRLIPFPSSVDSLAQVLGPSGNSLNPLSARRSSKRLSSIDTLPVFCGFTSASLRPIWELAESSQRQEILQKATKTFISPEIKRNAIVDVDIIVSDNYGVNPPYGYTKIDYDLEPQCQGQIYLFVLQSTEDISSRIPCGSEAHHCFVRGFWR

SEQ ID NO: 635 - protein, 523 aa, Selaginella biformis
MIMTISSHFPVAALWAAATLWKSIDPHYKQKQLWASDSGTPLGDHDDNLESLPGCNIVGCGYNVLHGYYADARSCLQDLFDLESSGMSKVSVGAKEFAKPNVVIMRPKYATSTYVETGKTIEQYNSSISSKTQLQGEYNFFSASVEVDIGIKQAESREYEFSKVQSDVETFVLQLDVDHEKMLKPQVKKDIDEMKDLDNLYDTYGTHYLRTIVMGGHATYTSSTNKNEFSSEFELGVVASMSFKALVGSISASEEAKYTSSIQSFNESSTTKIETSGGDPGLGGTYFAKHVDEWINSVKDYMTLADFVHGETVPLWRLASTAEREDALQKHYLDYCKRKQTTYTLSGIPPLRVRRVPVTEGFQPYYHVGTPDIGGNWSYFGQTNGYGYTIVVQETQPGSGVLGRIAKWEKIGDVYGCSVWRGVPADPVDYVVLSDFTHRGSNAPTAEETVGIMAVHRSCLISIGSGSGLDNPSWDFCMWGVDPVYNPKVSLLEDLKLYVMVIFSGQGTREMYRLLASELQVED

SEQ ID NO: 636 - protein, 356 aa, Huperzia nummulariifolia (Blume)
MRSKLKSDLKEALASMKVCVEGGIGQYESIGVVESVRNKYMGYRYVFVGGRTGQLYVQGVIGRSCSADYVATTKTSAFSSSTKISTVAESSFKSMAGMKVSATHDQLIQTFQENSSTKSSFKSVAGMDVSSKYKELIQIFQENSFTSLYAIGGSALSSITDTDTYNAWLSSIDTLPVFCGFTCESLQPIWELAESPQRQEILQKATQTFIPLEIKRNAIVDVDIVVSDNHKVNPPYGFTKVDYDLNNNANGKYIYLCYKQQKISVAGSPADPKPITALDVASGDDDDPDVPPGYTRINSDLNEGAGGKYIYLCYTKDPAAIPSDEDGLPILASALLVTKNSRMWLHLTDSRRLIKI

SEQ ID NO: 637 - protein, 368 aa, Selaginella kraussiana (Variegata)
MVISGAETKAVAAIQALGCGFDVTLDHKLEYAKSRLVDLDPETRTVVVPGNIIVEDVSMDIKVDKGENTRLRTDALDFHQMSERFNQGCGIAGKMPLGLLTAMYDLKGPWQLDALSTKCLAFDGYIAVLYEMKVAKSLISLLREVKDAVPSNWQPLELTRFIEKYGTHVITGVKVGGKDVIYLRQSQSSKLSAVDIQRYLESLAEQRFADGSGRRFKVFKKGAKTKVADPFAMIDRSKVINNFSSISISDDNVEVKFKRRGGLDSIRDHGPWLLSVPNAPEVVSMSFVPITSLLAGVPGTGFLTHAINLYLRYKPPIDELQFFLEYQVPRQWSPTLDASNQTSSSNLPALQFSPMGPKLHVSTDEVRS

SEQ ID NO: 638 - protein, 439 aa, Platycerium bifurcatum
MQSDTVMMYSDFTPTPRALIHTSSTLRSRKKSFLRATPVSTDIEYIAVRDTEIKTVSLRTKDAYSSKLAASVKLSGSYGSFSASVESDFSQSISDETDFTYTSVRTNVNKWKLSLKPTVEELRSMLTPSFKEALASMDSEELFTTYGTHYLSEVLVGGRADYVATTKTSAFSSDIQISVVAECSFKSVAGMDVSAKYKELIQKFQENSSTSLYAIGGTAISSITDTDTYNAWLSSIDTCPVFCGFTYESLQPIWELAESPQRQEILQKATKTFISPEIKRNAIVDVDIIVSDNYGVNPPFVLQATEDDLNRNAKGKFIFLCYNQQKISVAGSPADPKPITALYVASGDDDHPYVPPGYTRISSDLNEGAGGKFIYLCYTKDPAAIPSDEDGLPIRGIRVIGNENIDNVVTPYGFTKIDKDLNEGAGGDFIYVCFSRHLD

SEQ ID NO: 639 - protein, 277 aa, Selaginella victoriae (LW10889)
MIMEGNKSFAETKALSAIGALGCGFDVTLDLKLEYVKSSQSRLIHLDEEETRELVLPGDVICGNVSRDIKFDTGENTRYRSDVLDFHQMSERFNQNLGITGKMPLGLFTSMFEFKGPWQADASSTKSLALDGYFASLYELRVTRSQLTVRQEIKDALPSIWQPLELARFIERFGTHIITGIKIGGKDVIYLRQKHASTLNAAEIQKILEGLAEQRFVDSSEASGSGMRNFKKGARKKVRVAFHISTTEVCLNLTGCRSYRVFGPFKAEQQLRFCFHV

SEQ ID NO: 640 - protein, 315 aa, Huperzia goebelii (Holub)
MLKPSFKEALASMSSEELFTTYGTHYLSEVLVGGRADYVATTKTSAFSSDIQISVVAESSFKSVAGMDVSSKYKELIQIFQENSSTRLYAIGGTALSSITDTTTYNAWLSSIDTRPVFCGFTRDSLRPIWELAESPQRQEILQKATKTFIPLEIRRNAIVDVDIIVSDNCWANPPYGYTKIDYDLNRNAKGKYIFLCYNQQKISVAGSPADPKPITALYVASGDNNNPYVPPGYTMINKDLNAGAGGNFIYLCYTKDPAAIPNYQDGLPIRGIRVIGNEKVENVVTPYGFTKINTDLNDGAGGDYIFVCFSRHLD

SEQ ID NO: 641 - protein, 408 aa, Selaginella pallescens
MVPINSQYTIFEGDISRFLREEPLGITFNNKVFSRDTESLYREFSQTFGLNAQYRVVQISVEQSLQHIAGSETNVTALSIDVLTYSKKLSIRNEARTITRIPLREAFLQELRQLPEYPADGDNNWLPYLRFMRKWGSHYVNAVYYGSWFQQWSTASSTMRFTERQFQARACVAVEGVGNKFPSVEACAGVGEQEKRAASSLSMRTRLVVRGGEPRTASMLSSGQRTDELLQQFIEEGLDSTVAVRYEFTPLWTQVLADYGMNTREGRIASAMEAYYEGFLAFGCPRMTTTNNIAMQRFRRSVSNLYSCERKCEGCSVAADCNRIGNSQICKCFGNSCIRLIEDNPEDRVEVQTTRDDLRQNEGPNRSCQFSGSSCRCVASAESNCVAGYRAIWNQWDALAEKDAVQVM

SEQ ID NO: 642 - protein, 438 aa, Huperzia nummulariifolia (Blume)
MAQIEPLPGSDAIGHSYDVFGFYANPKSVNSQLFDFAPQQEIILEDHKWLLSTDIVYVAVRDTDIKTVSLCTKDEYSTELAASVKLSGSYGSFSASVESDFSQSISDDTDSTYTSVRTNVNKWKLSLKPTVEELRSMLTPSFKEALASMNSEELFTTYGTHYLSEVLVGGRADYVATTQTSAFSSDIQISVVAESSFKSVAGMDVSSKYKELIQIFQENSFTSLYAIGGSALSSITDTDTYNAWLSSIDSASLLPIWELAESPQRQEILQKATQTFIPLEIRRNAIVEVDIIVSDNHLVNPPYGYTKIDYDLNRNAEGKYIFLCYNQQKISVAGSPADPKPITALDVASGDDDDPDVPPGYTRINSDLNEGAGGKYIYLCYTKDPAAIPSDEIRGIRVIGNEKVEYVITPYGFTRINKDLNEGAKGDYIYVCFSRHLD

SEQ ID NO: 643 - protein, 257 aa, Huperzia goebelii (Holub)
MLTPSFKEALASMNSEELFTTYGTHYLSEVLVGGRADYVATTKTSAFSSDIQISVVAESSFKSVAGMDVSSKYKELIQIFQENSSTRLYAIGGTALSSITDTTTYNAWLSSIDTRPVFCGFTRDSLRPIWELAESPQRQEILQKATKTFIPLEIRRNAIVDVDIIVSDNCWANPPYGYTKIDYDLNRNAKGKYIFLCYNQQKISVAGSPADPKPITGLNVVSSDYPNPSVPSGYTMINTDLNQGAGGKFIYLCYTKD

SEQ ID NO: 644 - protein, 439 aa, Asplenium prolongatum x Asplenium antiquum (Kurata)
MWKMVAALIHLLLLLLLSVSAAGVSIGSTIYLPESNLGVSLSPVRNSIFEGNISSFLRSPVLQDIYHNTHQLTSDSVFGELGATFGLSVLPIEVLRFSLGATFRFLASSQANVSSALILVESYSKRQVLLNERSSLQKIPLRNDFLRELRDLPEPPFSVTADEDWVPYREFLIRWGSHYVSEVYYGSWLRTWSTAASSKSYTALQLQAKACAALTGVASIPAIEACANIDLGDMAEASRLDMNVQVEVRGGEPGTRAQLSVHRTDQLIRDFIEEGQKNEDAVVKYSLLPIWRPVLAQYRSPSTKEWKVATALEGYYNGYLAFSCPYIALSDPLKVVLQQFRRAPNGNGTYECVRQCQGCKRDRDCHLRGIGCYCYGRTCVAAPEGRARNQTSPDRLPRNVPPNVNCQYSFPSCKCHSISKEANCGTENLIPIWKQASGR

SEQ ID NO: 645 - protein, 451 aa, Huperzia tetratoides
MAHIEPLPGSDAIGHSYDVFGFYANPKSVQRQLFDFAPQQEITSEGHAWLLSTDIESIAVRDTEIKTVSLRTKDEYSRELAASVKVNGSYGGFSASVESDFSQSIAQETDSTYTSVRTNVNKWKLSVKPTVEELRSMLTPSFKEALASTDPVELFTTYGTHYLIEVLVGGRADYVATTKTSAFSSDTEIKVVAESSFKSLAGAEVSSDYKQLIQKFRENSSTSLYAVGGSALSSITDTATYDAWLSSIDTRPVFCGFTTDSLKPIWELAESPERREVLQKATETFIPPEITRNAIVGVDIVVSDNDAVNPPYGYTKINYDLNSNAKGKYIFLCYKQQKISVAGSPADPKPITALYVASGDNNHPSIPSGYTKINVDLNQGSGGKYIYLCYTKDPAAIPSDEDGLPIRGIRVIGSPNSGDVVTPYGFTRINKDLNEGAKGDFIYVCFSRHLD

SEQ ID NO: 646 - protein, 263 aa, Asplenium nidus var plicatum
MRSTSNTQRFQRTSDQVFRELGTTFSLSFPIKVLRLSFGATRSQTNVSSALILVESYSRRLLILNEQRSIQLIPLRADFLQELRNLPEPPTSITAASQWVSYRDFLLRWGSHYASEVYYGSWLRTWATAASTASYTQRQITAKGCADLTGSSTIPTIGGCRDISLSEMTAASRLDINVQIEVRGGEPGTRAQLTVRRTDQLIQDFIREGQVNDQADGLLQWLLVLPLSLQPPEQYSASAVSPPIHRHIPLCSTLPGLQGVQRL

SEQ ID NO: 647 - protein, 328 aa, Selaginella biformis
MTPVEVDIGIKQAESREYEFSKVQSDVETFVLQLDVDHEKMLKPQVKKDIDEMKDLDNLYDTYGTHYLRTIVMGGHATYTSSTNKNEFSSEFELGVVASMSFKALVGSISASEEAKYTSSIQSFNESSTTKIETSGGDPGLGGTYFAKHVDEWINSVKDYMTLADFVHGETVPLWRLASTAEREDALQKHYLDYCKRKQTTYTLSGIPPLRVRRVPVTEGFQPYYHVGTPDIGGNWSYFGQTNGYGYTIVVQETQPGSGVLGRIAKWEKIGDVYGCSVWRGVPADPVDYVVLSDFTLRLHNCGSGDSARLWCVGAHSQVGKDWRRLWL

SEQ ID NO: 648 - protein, 580 aa, Athyrium filix-femina
MCIEQVKAMAESMSSIERALHALCVVGSDEKDNGVTALGSQMLLKQPEGFSLNNASEASDEMLFAFSSSEESSAFQESVMKNGWNANLELKSKQNPFFQIHVSGSLEENMHHREEEKKEGKQHVAYIMKSLYIPKKSFQIPKHNMRLCDSALASVQEVKNLSDALRFLEAYGSHVSQSWYHLGGVLFEVITVSCAETTSLSDLLHEGARAMKASVTACSGFVGSATVKGSSSSSESHKTSSNKASNFKQSAKRVQALGPTNVRDEDEFRSKLEEGPSSWSIINKGVDRVEDLVAVWNILLQQRQYAETDHAKEILERAAMLLYKAWLNKARSSRRQYRQMIAALIECEERNYYRFQHQLQLHHVDEPEEEVSPLAAALTWVSPAVELPQKLQTVLADQSSLDLSPKVSYFLRSCIAHLSSTSGGENDLRKIVIVINRYGYDQYGNAEFSMYAQHLRSMIEDLNKLNRMEENSTDPQHPIDLNWENTSFCLTIDDCLQIPAEYTYIGDVLVDKPLMKQKQGGGQIQSAHARQLILIDRLRHNLDPFQRPSLEGKPKWKRNSSRANKLAGAQQDPGSRKLCI

SEQ ID NO: 649 - protein, 406 aa, Platycerium bifurcatum
MALIEPLPGSDAIGHSYDVFGFYANPKSVNTQLFDFAPQQEIILEDHKWLLSTDIEYIAVRETEIKTVSLRTKDAYSTELAASVKVSGSYGSFSASVESDFSQSISDETDSTYTSVRTNVNKWKLSLKPTVEELRSMLTPSFKEALASMDSEELFTTYGTHYLSEVLVGGRADYVATTKTSAFSSDIQISVVAECSFKSVAGMEVSSQYKELIKTFQENSSTRLYAIGGTALSSICSFKSVAGMEVSSQYKELIKTFQENSSTRLYAIGGTTISSITDKDTYNAWLSSIDTRPVFCGFTYESLQPIWELAESPQRQEILQKATKTFISPEIRRNAPEIKRNAIVDVDIIVSDNYGVNPPYGYTKIDYDLNRNAKGKYIFLCYTEDISSRIPCGSEAHHCFVRGFWR

SEQ ID NO: 650 - protein, 451 aa, Huperzia squarrosa
MVHIEPLPGSDAIGHSYDVFGFYANPKSVKKELFDFALQKEITSEGHTWLLSTDIEYIAVRDTEIKTVSIRTKDAYSSELAASVKLCGSYGGFSASVESDFSESISDETDSTYTSVRTNVNKWKLSLKHTVEELRSKLKPALKEALASMKAVELLSTYGTHYMAEVLVGGRADYVATTKNSAFSSDTKISIVAESSFKSVAGMKVSAEQKQLIEKFQENSSTSLYAIGGSALSSITNTATYNAWLSSIDTRPVFCGFTRDSLRPIWELAESPRRREILRTATQTFIPSGITRNAIVGVDIIVSDNYSVNPPYGYTRRSYDLNRNAKGKYIFLCYKQQKISVAGSPADPTPITALYVASGDDDNPYVPPGYTKIDKDLNKDHGGKFIYLCYTKDPAAIPNDEDGLPIRGIRVIGSKKVENVVTPYGYTRIEEDLNKGAGGDFIFICFSRHLD

SEQ ID NO: 651 - protein, 364 aa, Selaginella kraussiana (Variegata)
MAEHSEQKGSLILESLEEGRKLPGTEILGSGYDVLGGYYADPRSCLVNLFDFPAEVETVQIGNQEFSKSTGIVYHSSIGTDLDMSSGKSIQEYTKEINSKTKLEGNYSFFSASIEADIGIKSAQKSENEFSKAQYNVKFFTLQLPPHHSKMLKPQIKDDIDNMSDLVRLFDMYGTYYLAGILMGGAASSTSSTSTSTFNSSLDVSVAAKIAFQWSIGGLSAEEQAEYKQQVKSFNESSETTVRTTGGKPGIKFPAEIGEWSDSILDYMAFVDYLGSRSLVGIWELASTRERQDELHKFYHKYCRFRQMQIIPLLRARVVPFAQMSRLGSNLAAWAPDEPDMPFGWYYLGQVWYTRAPTKWSRPS

SEQ ID NO: 652 - protein, 431 aa, Platycerium bifurcatum
MHTPTPTPRALIHTSSTLRSRKKSFLRATPVSTDIEYIAVRDTEIKTVSLRTKDAYSSKLAASVKLSGSYGSFSASVESDFSQSISDETDFTYTSVRTNVNKWKLSLKPTVEELRSMLTPSFKEALASMDSEELFTTYGTHYLSEVLVGGRADYVATTKTSAFSSDIQISVVAECSFKSVAGMDVSAKYKELIQKFQENSSTSLYAIGGTAISSITDTDTYNAWLSSIDTCPVFCGFTYESLQPIWELAESPQRQEILQKATKTFISPEIKRNAIVDVDIIVSDNYGVNPPFVLQATEDDLNRNAKGKFIFLCYNQQKISVAGSPADPKPITALYVASGDDDHPYVPPGYTRISSDLNEGAGGKFIYLCYTKDPAAIPSDEDGLPIRGIRVIGNENIDNVVTPYGFTKIDKDLNEGAGGDFIYVCFSRHLD

SEQ ID NO: 653 - protein, 469 aa, Selaginella biformis
MIMTISSHFPVAALWAAATLWKSIDPHYKQKQLWASDSGTPLGDHDDNLESLPGCNIVGCGYNVLHGYYADARSCLQDLFDLESSGMSKVSVGAKEFAKPNVVIMRPKYATSTYVETGKTIEQYNSSISSKTQLQGEYNFFSASVEVDIGINQAENLQNEFTKVQSDVETFVLQLDVGHEKMLKPQVKKDIDEMKDLDNLYDTYGTHYLRTIVMGGHATYTSSTNKNEFSSEFELGVVASMSFKALVGSISASEEAKYTSSIQSFNESSTTKIETSGGDPGLGGTYFAKHVDEWINSVKDYMTLADFVHGETVPLWRLASTAEREDALQKHYLDYCKRKQTTYTLSGIPPLRVRRVPVTEGFQPYYHVGTPDIGGNWSYFGQTNGYGYTIVVQETQPGSGVLGRIAKWEKIGDVYGCSVWRGVPADPVDYVVLSDFTLRLHNCGSGDSARLWCVGAHSQVGKDWRRLWL

SEQ ID NO: 654 - protein, 344 aa, Huperzia salvinioides
MTRIPLTLQFVNVNKWKLSLKPTVEELRSMLTPSFKEALASMNSEELFTTYGTHYLSEVLVGGRADYVATTKTSAFSSDIQISVVAESSFKSVAGMDVSSKYKELIQIFQENSSTSLYAIGGSALSSITDTATYNAWLTSIDTRPVFCGFTCESLQPIWELAETPQRQEILQKATMTFIPPEIRRNAIVDVDIIVSDNYSVNPPYGYTKIDYDLNRNAEGKYIFLCYNQQKISVAGSPADPKPITALDVASGDDDDPDVPPGYTRINSDLNEGAGGKYIYLCYTKDPAAIPSDEDGLPIRGIRVIGNEKLENVVTPYGFTKIDKDLNEGAGGDYIFVCFSRHLD

SEQ ID NO: 655 - protein, 553 aa, Selaginella victoriae
MASPVLVHLNSPLPSSGNSSGGYCSTRLNASIFKETEVDKLFASLDRDYKQKRLSPDESSEVRMLPGDERSAGGDDFGLEWVPGCHSVGCGYNALTGYYADARSCLPRLFDMESGTFSKVSIADKEFALPRILAMRPRWAASTYIDTGKSIHEYNNSFRSKTGLEGNYNFFSASVEADIGITEAKNEQNEFCRVQSNVETFILQLGVGHENMLKPQVKNDIDTTKDLDKLYDTYGTHYLRTIVMGGHASYTSSTNKIRFQSEFKLDVVASMSFKFLMGGMSASEELRYKTSIESFNESSKVVIRTTGGDPGLGGPNLPKHIDEWLGSVKSFMSLSDFIRGETVPIWMLASTAARQTQLRNHYLDYCKRKQANYLTVPPLRVRRVPVTNSIYWGIGTPDIDGNWSYFAQAVAGDTLVVRETDPGSGMLGGISRWEMMVDNIDMWQDGFGSAWRGVPENPVDYVCLGDFVCRGRGPPTAEETRGIRSVHRSCVVPSRILSPDFHMPGWVMMGIYPVHNPKESSLQDLQPYLMLLRTPNQLSRQSYELSERRLLTS

SEQ ID NO: 656 - protein, 359 aa, Huperzia phlegmaria
MAQIEPLPGSDAIGHSYDVFGFYANPKSVKKELFDFALQKEITLEGHTWLLSTDIEHIAVRDTDINTVSLRTKDAYSTELAASVKVSGSYGSFSASVESDFSQSISDETDSTYTSVRTNVNKWKLSLKHTVEELRSKLKPALKEALANMKEVELLSTYGTHYMGEVLVGGRADYVATTKTSAFSSDTKISVVAESSFKSVAGMEVSAEYKELIKKFQENSSTRLYALGGSALSSITDTASYNAWFSSIDTRPVFCGFTRDSLRPIWELAESPQRREILRKAAQTFIPPEITRNAIVGVDIIMSDNYWVNPPYGYTKIDYDLNRNAKGKYIFLCYNQQKIFVGIPCGSDAHHCLVRGFWR

SEQ ID NO: 657 - protein, 477 aa, Selaginella pallescens
MAEHSEQKGSLILESLEEGRKLPGTEILGSGYDVLGGYYADPRSCLVNLFDFPAEVETVQIGNQEFSKSTGIVYHSSIGTDLDMSSGKSIQEYTKEINSKTKLEGNYSFFSASIEADIGIKSAQKSENEFSKAQYNVKFFTLQLPPHHSKMLKPQIKDDIDNMSDLVRLFDMYGTYYLAGILMGGAASSTSSTSTSTFNSSLDVSVAAKIAFQWSIGGLSAEEQAEYKQQVKSFNESSETTVRTTGGKPGIKFPAEIGEWSDSILDYMAFVDYLGSRSLVGIWELASTRERQDELHKFYHKYCRFRQMQIIPLLRARVVPFAQMSRLGSNLAAWAPDEPDMPFGWYYLGQVWYHTGPYKMVPAVFALIVQEMEPGMLADVRSWSKVGDGPEGSSFWHGSSASEDHLVLGNFFHDKSNPPTALESFGIKAVHMDCLVPANLGYYHNMPGSDVLLGLKVWPVVAADDTAIPMDKLLCCS

SEQ ID NO: 658 - protein, 315 aa, Huperzia phlegmaria
MLTPSFKEALASMNSEELFTTYGTHYLNEVLVGGRADYVATTKTSAFSSDTKISVVAESSFKSVAGMEVSAEQKQLIEKFQENSSTSPYAIGGSALSSITDTASYNAWLSSIDTLPVFCGFTYESLQPIWELAESPQRQEILQKATQTFIPLEIRRNAIVDVAIIVSDSHLVNPPYGFTKIDFDLNRGAKGKFIYLCYKQQKISVAGSPADPKPITALNVVSSDYPNPSVPSGYTMINTDLNQGSGGKFIYLCYTKDPAAIPSDEDGLPIRGLRVIGNQQVGNVITPYGFTRINKDLNEGAGGDYIFVCFSRHLD

SEQ ID NO: 659 - protein, 419 aa, Huperzia nummulariifolia (Blume)
MAQIEPLPGSDAIGHSYDVFGFYANPKSVNSQLFDFAPQQEIILEDHKWLLSTDIVYVAVRDTDIKTVSLCTKDEYSTELAASVKLSGSYGSFSASVESDFSQSISDDTDSTYTSVRTNVNKWKLSLKPTVEELRSMLTPSFKEALASMNSEELFTTYGTHYLSEVLVGGRADYVATTQTSAFSSDIQISVVAESSFKSVAGMDVSSKYKELIQIFQENSFTSLYAIGGSALSSITDTDTYNAWLSSIDTLPVFCGFTCESLQPIWELAESPQRQEILQKATMTFIPPEIRRNAIVDVDIIVSDNYSVNPPYGYTKIDYDLNRNAEGKYIFLCYNQQKISVAGSPADPKPITALDVASGDDDDPDVPPGYTRINSDLNEGAGGKYIYLCYTKDPAAIPSDEDGLPILASALLVRKKPSM

SEQ ID NO: 660 - protein, 381 aa, Huperzia carinata
MAQIEPLPGSDAMAQIEPLPGSDAIGHSYDVFGFYANPKSVKRELFDFAPQQEITEEGHTWLLSTDIVNTAVRDTEIKTVSLRTKDEYSTELAASVKVSGSYGGFSASVESDFSQSISQETDSTYTSVRTNVTKWKLGLKPTVEELRSMLTPSFKEALASMESEELFTTYGTYYLSEVLVGGRADYVATTKTSAFSSDTQISVVAESSFKSVAGMEVSSQYKELIKKFQENSSTRLYAIGGTALSSITDTATYNAWLSSIDTLPVFCGFTSASLKPIWELAESSQRQEILQKAAQTFIPLEIRRNAIVDVAIIVCGFTSTSLMPIWKLAESPQRQEILQKATQTFIPLEVRRNAIVEVDIIVSDVRQPSGESSLRLYEDRF

SEQ ID NO: 661 - protein, 344 aa, Huperzia salvinioides
MTRIPLTLQFVNVNKWKLSLKPTVEELRSMLTPSFKEALASMNSEELFTTYGTHYLSEVLVGGRADYVATTKTSAFSSDIQISVVAESSFKSVAGMDVSSKYKELIQIFQENSSTSLYAIGGSALSSITDTATYNAWLTSIDTRPVFCGFTCESLQPIWELAETPQRQEILQKATMTFIPPEIRRNAIVDVDIIVSDNYSVNPPYGYTKIDYDLNRNAEGKYIFLCYNQQKISVAGSPADPKPITALDVASGDDDDPDVPPGYTRINSDLNEGAGGKYIYLCYTKDPAAIPSDEDGLPIRGIRVIDNEKIENVITPYGFTRIDRDLNEGAGGYNIFVCFSRHLD

SEQ ID NO: 662 - protein, 376 aa, Selaginella victoriae
MSSNNVEVMFRRRGGLDSKKDHSSWLASVPERPEVISMSFVPITSLLSGVPGAGFLTHAINLYLRYKPPLEELHYFLEFQIPRQWTPPLELPSNVSNSGLPVLQFSPFGAKLYVSLEEATVGRLPVTGLEVTYVLLVLPFLKHGVQATVGRLPVTGLRLYIQGKRRNRLSVHLQYLASLPRILASHWGTNVYSETPVWMKSEDNPKWFLPVQWKSYSQVNTAPVEFGASYIGDKGAAFVVTGAQLQVSTHKTRNVLYLGLQFTRIPGCSVRRSAWDNMPTASQKSGSGFFSQLGLSTTLSTLNASPAPERFVQNSAVFSGEPSVSTKNSKMRKYVDITEMSKGIQDQPGHWIISGGKLDVENGKIFLKVKYSLLKY

SEQ ID NO: 663 - protein, 423 aa, Huperzia nummulariifolia (Blume)
MAQIEPLPGSDAIGHSYDVFGFYANPKSVNSQLFDFAPQQEIILEDHKWLLSTDIVYVAVRDTDIKTVSLCTKDEYSTELAASVKLSGSYGSFSASVESDFSQSISDDTDSTYTSVRTNVNKWKLSLKPTVEELRSMLTPSFKEALASMNSEELFTTYGTHYLSEVLVGGRADYVATTQTSAFSSDIQISVVAESSFKSVAGMDVSSKYKELIQIFQENSFTSLYAIGGSALSSITDTDTYNAWLSSIDSASLLPIWELAESPQRQEILQKATQTFIPLEIRRNAIVEVDIIVSDNHLVNPPYGYTKIDYDLNRNAEGKYIFLCYNQQKISVAGSPADPKPITALDVASGDDDDPDVPPGYTRINSDLNEGAGGKYIYLCYTKDPAAIPSDEDGLPILASALLVTKNSRMWLHLTDSRRLIKI

SEQ ID NO: 664 - protein, 320 aa, Huperzia goebelii (Holub)
MLTPSFKEALASMNSEELFTTYGTHYLSEVLVGGRADYVATTKTSAFSSDIQISVVAESSFKSVAGMDVSSKYKELIQIFQENSSTRLYAIGGTALSSITDTTTYNAWLSSIDTRPVFCGFTRDSLRPIWELAESPQRQEILQKATKTFIPLEIRRNAIVDVDIIVSDNCWANPPYGYTKIDYDLNRNAKGKYIFLCYNQQKISVAGSPADPKPITGLNVVSSDYPNPSVPSGYTMINTDLNQGAGGKFICLCYTKDPAAIPNYQDGLPIRGIRVIGNEKVENVVTPYGFTKINTDLDLNEGAKGEGGDYIFVCFSRHLD

SEQ ID NO: 665 - protein, 291 aa, Huperzia nummarifolia
MKVSAEQKQLIEKFQENSSTSLYAIGGSALSSITDTATYNAWLSSIDTRPVFCGFTRDSLRPIWELAESPQRREILRKATQTFIPPEITRNAVVGVDIIMSDNYWVNPPYGSQRREILQKATETFIPPEITRNAVVGVDIIMSDNYWVNPPYGYTKIDYDLNRNAKGKYIFLCYKQQKISVAGSPADPKPITALYVTSGDDYNPYVPPGYTKIDKDLNKDAGGKFIYLCYTKDPAAIPNDEDGLPIRGIRVIGNEKLENVVTPYGFTRIDKDLNKDAKGDYIFVCFSRHLD

SEQ ID NO: 666 - protein, 389 aa, Asplenium nidus var plicatum
MRSTSNTQRFQRTSDQVFRELGTTFSLSFPIKVLRLSFGATFRSIASSQTNVASALILVESYSRRLLILNEQRSIQQIPLRADFLQELRNLPEPPTSITAAAQWASYRQFLLRWGSHYASEVYYGSWLRTWATAASTKSYTQRQITAKGCADLTGSSRIPIIGGCRDIAISEMTAASRLDINVQIEIRGGESGTRAELAVRRTDRLIQDFIREGQVNDEADVKYGLAPIWRPVLARYHSATSKEWRVATALEAYYNGFLSFPCPYNIENGIVLQQFRRITTGTYRCVRPCQGCRDFHDCNLRQFGCYCYGRTCVAAGGEDNRAWIQTRFEGTRRDDASLSCVYRFPSCRCDAQYREANCGSDRFLTIWDQTKLYVNAKGSDTAEALSME

SEQ ID NO: 667 - protein, 321 aa, Selaginella victoriae
MTELDKVYDTYGTHYLGSIVMGGHASYTSATNKNKFKSSLELGFAAQVAGSLSVEEKVKYKSDIESFSESSSTKIQTSGGDPGLSGPDFPEHVGQWMDSVKEYMTLADFIAGETLGLWKLASTAQRQQQLRDHYSDYCKRNQSHFSGDVRPLRVKVVPLTNTIIENNWFSVSSPDVGGDWSYLGQVWDINGSTIVVAEAEPGSGILGDIARWEKIYEYDNHSYWRGVASNPVDYAVLSDFMKEGDSEPSAEETAGIKAVHTSCLTTEVCTASGYFSHGIYPVQMPYDPSLDNIKPYYWVTGDSEDQRQVHHLKGSCLQVEG

SEQ ID NO: 668 - protein, 318 aa, Huperzia carriata (Solomon Islands)
MLTPLFKEDLASMNSEELFTTYGTHYLSDVLVGGRTDYVATTKTSRFSSDSEISVAAESAFKSVAGMEVSSQYKELIKKFQENSSTSLYAMYAIGGTELSSITDTATYNKWLSSIDTLPVFCGFTSASLKPIWELAESSERQEILQKATKTFIPPEIRQNAIVDVDIIVSDDSSVNPPDGYTKIDYDLNHNAKGKYIFLCYNQQKISVAGSPADPKPITALYVASGDNNNPYVPPGYTMINRDLNAGAGGNFIYLCYTKDPAEIPNDEDGLPIRGIRVIGNEKVENVVTPYGFTKIDKDLNEGAGGDFIFVCFSRHLD

SEQ ID NO: 669 - protein, 382 aa, Selaginella biformis
MTPTAVDIGIKQAESREYEFSKVQSDVETFVLQLDVDHEKMLKPQVKKDIDEMKDLDNLYDTYGTHYLRTIVMGGHATYTSSTNKNEFSSEFELGVVASMSFKALVGSISASEEAKYTSSIQSFNESSTTKIETSGGDPGLGGTYFAKHVDEWINSVKDYMTLADFVHGETVPLWRLASTAEREDALQKHYLDYCKRKQTTYTLSGIPPLRVRRVPVTEGFQPYYHVGTPDIGGNWSYFGQTNGYGYTIVVQETQPGSGVLGRIAKWEKIGDVYGCSVWRGVPADPVDYVVLSDFTHRGSNAPTAEETVGIMAVHRSCLISIGSGSGLDNPSWDFCMWGVDPVYNPKVSLLEDLKLYVMVIFSGQGTREMYRLLASELQVED

SEQ ID NO: 670 - protein, 539 aa, Selaginella biformis
MADSPLVSVNLRAAVRENGYRMLKSPVFKEQHLERLWKSIDPHYKQKQLWASDSGTPLGDHDDNLESLPGCNIVGCGYNVLHGYYADARSCLQDLFDLESSGMSKVSVGAKEFAKPNVVIMRPKYATSTYVETGKTIEQYNSSISSKTQLQGEYNFFSASVEVDIGINQAENLQNEFTKVQSDVETFVLQLDVGHEKMLKPQVKKDIDEMKDLDNLYDTYGTHYLRTIVMGGHATYTSSTNKNEFSSEFELGVVASMSFKALVGSISASEEAKYTSSIQSFNESSTTKIETSGGDPGLGGTYFAKHVDEWINSVKDYMTLADFVHGETVPLWRLASTAEREDALQKHYLDYCKRKQTTYTLSGIPPLRVRRVPVTEGFQPYYHVGTPDIGGNWSYFGQTNGYGYTIVVQETQPGSGVLGRIAKWEKIGDVYGCSVWRGVPADPVDYVVLSDFTHRGSNAPTAEETVGIMAVHRSCLISIGSGSGLDNPSWDFCMWGVDPVYNPKVSLLEDLKLYVMVIFSGQGTREMYRLLASELQVED

SEQ ID NO: 671 - protein, 426 aa, Huperzia salvinioides
MTRIPLTLQFVNVNKWKLSLKPTVEELRSMLTPSFKEALASMNSEELFTTYGTHYLSEVLVGGRADYVATTKTSAFSSDIQISVVAESSFKSVAGMDVSSKYKELIQIFQENSSTSLYAIGGSALSSITDTATYNAWLTSIDTRPVFCGFTCESLQPIWELAETSERREILQKATQTFIPLEIRRNAIVEVDIIVSDNHLVNPPYGYTKIDYDLNRNAEGKYIFLCYNQQKISVAGSPADPKPITALDVASGDDDDPDVPPGYTRINSDLNEGAGGKYIYLCYTKDPAAIPSDEDGLPIRGIRVIGNEKVEYVITPYGFTRINKDLNALDVASGDDDDPDVPPGYTRINSDLNEGAGGKYIYLCYTKDPAAIPSDEDGLPIRGIRVIGNEKLENVVTPYGFTKIDKDLNEGAGGDYIFVCFSRHLD

SEQ ID NO: 672 - protein, 294 aa, Huperzia phlegmaria
MAQIESLPQSSDYAMDQIEPLPGSDAIGHSYDVFGFYANPKSVKKELFDFALQKEITLEGHTWLLSTDIVHIAVRDTDINTVSLRTKDAYSTELAASVKVSGSYGSFSASVESDFSQSISDETDSTYTSVRTNVNKWKLSLKPTVEELRSMLTPSFKEALASMNSEELFTTYGTHYLSEVLVGGRADYVATTKTSAFSSDTKISVVAESSFKSVAGMEVSAEYKELIKKFQENSSTRLYALGGSALSSITDTASYNAWFSSIDTRPVFCGFTHESLQPIWELAESPQRQEILHR

SEQ ID NO: 673 - protein, 300 aa, Huperzia goebelii (Holub)
MNAVELFSTYGTHYMGEVLVGGRADYVAITKTSAFSSDTKISAVAESSFNSMAGVKVSAAQKELIQIFQENSSTRLYAIGGTALSSITDTTTYNAWLSSIDTRPVFCGFTRDSLRPIWELAESRLCRETLRKATETFIPRGITRNAIVEVDIITSDNCWANPPYGYTKIDYDLNRNAKGKYIFLCYNQQKISVAGSPADPKPITALYVTSGDDYYPYVPRGYTKIDKDLNMNAGGKYIFLCYTKDPAASRDGLPIRGVRVIGNEKFENVVTPYGYTRIDEDLNNGAGGDYIFVCFSRHVD

SEQ ID NO: 674 - protein, 278 aa, Selaginella pallescens
MRKWGSHYVNAVYYGSWFQQWSTASSTMRFTERQFQARACVAVEGVGNKFPSVEACAGVGEQEKRAASSLSMRTRLVVRGGEPRTASMLSSGQRTDELLQQFIEEGLDSTVAVRYEFTPLWTQVLADYGMNTREGRIASAMEAYYEGFLAFGCPRMTTTNNIAMQRFRRSVSNLYSCERKCEGCSVAADCNRIGNSQICKCFGNSCIRLIEDNPEDRVEVQTTRDDLRQNEGPNRSCQFSGSSCRCVASAESNCVAGYRAIWNQWDALAEKDAVHAIG

SEQ ID NO: 675 - protein, 446 aa, Huperzia phlegmaria
MAQIESLPQSSDYAMDQIEPLPGSDAIGHSYDVFGFYANPKSVKKELFDFALQKEITLEGHTWLLSTDIVHIAVRDTDINTVSLRTKDAYSTELAASVKVSGSYGSFSASVESDFSQSISDETDSTYTSVRTNVNKWKLSLKPTVEELRSMLTPSFKEALASMNSEELFTTYGTHYLSEVLVGGRADYVATTKTSAFSSDTKISVVAESSFKSVAGMEVSAEYKELIKKFQENSSTRLYALGGSALSSITDTASYNAWFSSIDTRPVFCGFTHESLQPIWELAESPQRQEILQKATKTFIPPEIRRNAIVDVAIIVSDSHLVNPPYGFTKIDFDLNRGAKGKFIYLCYKQQKISVAGSPADPKPITALNVVSSDYPNPSVPSGYTMINTDLNQGSGGKFIYLCYTKDPAAIPSDEDGLPIRGLRVIGMKKSRMWLHLTDSRRLIKI

SEQ ID NO: 676 - protein, 252 aa, Selaginella victoriae (LW10887)
MFILQLPIDHQTMLKPKVKEDIDNMTDLDKVYDTYGTHYLGSIVMGGHASYTSATNKNKFKSSLELGFAAQVAFKSLVGSLSVEEKVKYKSDIESFSESSSTKIQTSGGDPGLSGPDFPEHVGQWMDSVKEYMTLADFIAGETLGLWKLASTAQRQQQLRDHYSDYCKRNQSHFSGDVRPLRVKVVPLTNTIIENNWFSVSSPDVGGDWSYLGQVWDINGSTIVVAEAEPGSGILGDIARWEKIYETAIGVG

SEQ ID NO: 677 - protein, 365 aa, Platycerium bifurcatum
MALIEPLPGSDAIGHSYDVFGFYANPKSVNTQLFDFAPQQEIILEDHKWLLSTDIEYIAVRETEIKTVSLRTKDAYSTELAASVKVSGSYGSFSASVESDFSQSISDETDSTYTSVRTNVNKWKLSLKPTVEELRSMLTPSFKEALASMDSEELFTTYGTHYLSEVLVGGRADYVATTKTSAFSSDIQISVVAECSFKSVAGMEVSSQYKELIKTFQENSSTRLYAIGGTALSSICSFKSVAGMEVSSQYKELIKTFQENSSTRLYAIGGTTISSITDKDTYNAWLSSIDTRPVFCGFTYESLQPIWELAESPQRQEILQKATKTFISTVLGPSGSLLNSLCAGRFSEKLPKRLSHTKCNCWRRG

SEQ ID NO: 678 - protein, 260 aa, Huperzia carinata
MACIEPLPGSDAIGHSYDVFGFYANPKSVKRELFDFAPQQEITEEGHTWLLSTDIEYIAVLDTEIKTVSLGTKDAYSSELAASVKLSGSYGGFSASVESDFSQSISQETDSTYTSVRTNVTKWKLGLKPTVEELRSMLTPSFKEALASMESEELFTTYGTYYLSEVLVGGRADYVATTKTSAFSSDTQISVVAESSFKSVAGMEVSSQYKELIKKFQENSSTRLYAIGGTALSSITDTATYNACGSALSNVTYTATYNAW

SEQ ID NO: 679 - protein, 465 aa, Huperzia goebelii (Holub)
MAEIESLPQSSDYAMDQIEPLPGSDAIGHSYDVFGFFANPKSVKRQLFNFASQEEITLEGHSWLLSTDIEYTAVRDTDIKTVSYRTKDAYSTELAASVKVSGSYGSFSASVESDFSQSISDETDSTYTSVRTNVTKWKLSLKRTVEELRSMLKPSFKEALASMSSEELFTTYGTHYLSEVLVGGRADYVATTKTSAFSSDTEIKLAAESSFKSMAGMGNSSQYKELIQKFQENSSILLYAIGGTALSSITDTTTYNAWLSSIDTRPVFCGFTRDSLRPIWELAESPQRQEILQKATKTFIPLEIRRNAIVDVDIIVSDNCWANPPYGYTKIDYDLNRNAKGKYIFLCYNQQKISVAGSPADPKPITGLNVVSSDYPNPSVPSGYTMINTDLNQGAGGKFICLCYTKDPAAIPNYQDGLPIRGIRVIGNEKVENVVTPYGFTKINTDLNDGAGGDYIFVCFSRHLD

SEQ ID NO: 680 - protein, 277 aa, Selaginella kraussiana (Variegata)
MRKWGSHYVNAVYYGSWFQQWSTASSTMRFTERQFQARACVAVEGVGNKFPSVEACAGVGEQEKRAASSLSMRTRLVVRGGEPRTASMLSSGQRTDELLQQFIKEGLDSTVAVRYQFTPLWTQVLAVYGMNTREGRIASAMEAYYEGFLAFGCPRMTTTNNIAMQRFRRSVSNLYSCERKCEGCSVAADCNRIGNSRICNCFGNSCIRLIEGNPEGRVEVQTTRDDLRQNEGPNRSCQFSGSSCRCVASAESNCVAGYRAIWNQWDALAEKDAVQVM

SEQ ID NO: 681 - protein, 252 aa, Huperzia carinata
MAGMESSSEYKELIQKFQENSSTRLYAIGGTALSSITDTATYNAWLSSIDTLPVFCGFTSASLKPIWELAESSQRQEILQKAAQTFIPLEIRRNAIVDVAIIVSDNHLVNPPYGFTKIDFDLNRGAKGKFIYLCYKQQKISVAGSPTDPKPITDLYVASGDNKDPSVPRGYTKINRDLNDGAGGKYIYLCYTKDPAEIPDDEDGLPIRGIRVIGKTKAIDVITPYGFTRIDTDLNDGAGGDYIFVCFSRHLD

SEQ ID NO: 682 - protein, 331 aa, Huperzia salvinioides
MNKWKLSEAQCGKAALPVEACVEGGIGEYESSGAVEYLRDNYMGEVLVGGRGDYVATTKTSAFSSSTKISTVAESSFKSMAGMKVSATHDQLIQTFQENSSTSLYAIGGTALSSITDTATYNAWLTSIDTRPVFCGFTRESLQPIWELAESPQRREILQKATQTFIPSGITRNAIVGVDIIISDSYWVNPPYGYTKIDYDLNRNAKGKYIFLCYKQQKISVARSPVDPKPITALDVASGDDDNPYVPSGYTKINKDLNKGAGGKFIYLCYTKDPAAIPNYEDGLPIRGIRVIDDEKLENVVTPYGYTRIDEDLNKGAGGDYIFVCFSRHLD

SEQ ID NO: 683 - protein, 384 aa, Huperzia phlegmaria
MARIEPLPGSDAIGHSYDVFGFYANPKSVKKELFDFALQKEITLEGHTWLLSTDIVHIAVRDTDINTVSLRTKDAYSTELAASVKVSGSYGSFSASVESDFSPSELAASAKVSGSYGSFSASVESDFSQSISDETDSTYTSVRTNVNKWKLSLKHTVEELRSKLKPALKEALANMKEVELLSTYGTHYMGEVLVGGRADYVATTKTSAFSSDTKISVVAESSFKSVAGMEFPRSFFFFLRNSFFFFTSLYAIGGSALSSITDAATYNAWLTSIDTRPVFCGFTRDSLRPIWELAESPQRREILRKAAQTFIPPEITRNAIVGVDIIMSDNYWVNPPYGYTKIDYDLNRNAKGKYIFLCYNQQKIFVGIPCGSDAHHCLVRGFWR

SEQ ID NO: 684 - protein, 425 aa, Huperzia carinata
MACIEPLPGSDAIGHSYDVFGFYANPKSVKRELFDFAPQQEITEEGHTWLLSTDIVNTAVRDTEIKTVSLRTKDEYSTELAASVKVSGSYGGFSASVESDFSQSISQETDSTYTSVRTNVTKWKLGLKPTVEELRSMLTPSFKEALASMESEELFTTYGTYYLSEVLVGGRADYVATTKTSAFSSDTQISVVAESSFKSVAGMEVSSQYKELIKKFQENSSTRLYAIGGTALSSITDTATYNAWLSSIDTLPVFCGFTSASLKPIWELAESSQRQEILQKAAQTFIPLEIRRNAIVDVAIIVSDNHLVNPPYGFTKIDFDLNRGAKGKFIYLCYKQQKISVAGSPADPKPITALNVVSSDYHDPSAPSGYTMINTDLNQGAKGKFIYLCYTKDPAAYLSLLHKRSGCNTQRRGWTAHTWHPRYRQ

SEQ ID NO: 685 - protein, 348 aa, Selaginella victoriae
MSSNNVEVMFRRRGGLDSKKDHSSWLASVPERPEVISMSFVPITSLLSGVPGAGFLTHAINLYLRYKPPLEELHYFLEFQIPRQWTPPLELPSNVSNSGLPVLQFSPFGAKLYVSLEEATVGRLPVTGLRLYIQGKRRNRLSVHLQYLASLPRILASHWGTNVYSETPVWMKSEDNPKWFLPVQWKSYSQVNTAPVEFGASYIGDKGAAFVVTGAQLQVSTHKTRNVLYLGLQFTRIPGCSVRRSAWDNMPTASQKSGSGFFSQLGLSTTLSTLNASPAPERFVQNSAVFSGEPSVSTKNSKMRKYVDITEMSKGIQDQPGHWIISGGKLDVENGKIFLKVKYSLLKY

SEQ ID NO: 686 - protein, 451 aa, Huperzia carinata
MAQIEPLPGSDAIGHSYDVFGFYANPKSVKRELFDFAPQQEITEEGHTWLLSTDIVNTAVRDTEIKTVSLRTKDEYSTELAASVKVSGSYGGFSASVESDFSQSISQETDSTYTSVRTNVTKWKLGLKPTVEELRSMLTPSFKEALASMESEELFTTYGTYYLSEVLVGGRADYVATTKTSAFSSDTQISVVAESSFKSVAGMEVSSQYKELIKKFQENSSTRLYAIGGTALSSITDTATYNAWLSSIDTLPVFCGFTSASLKPIWELAESSQRQEILQKAAQTFIPLEIRRNAIVDVAIIVSDNHLVNPPYGFTKIDFDLNRGAKGKFIYLCYKQQKISVAGSPTDPKPITDLYVASGDNKDPSVPRGYTKINRDLNDGAGGKYIYLCYTKDPAEIPDDEDGLPIRGIRVIGKTKAIDVITPYGFTRIDTDLNDGAGGDYIFVCFSRHLD

SEQ ID NO: 687 - protein, 360 aa, Huperzia goebelii (Holub)
MAQIEPLPGSDAIGHSYDVFGFFANPKSVKRQLFNFASQEEITLEGHSWLLSTDIEYTAVRDTDIKTVSYRTKDAYSTELAASVKVSGSYGSFSASVESDFSQSISDETDSTYTSVRTNVNKWKLSLKPTVEELRSMLTPSFKEALASMNSEELFTTYGTHYLSEVLVGGRADYVATTKTSAFSSDIQISVVAESSFKSVAGMDVSSKYKELIQIFQENSSTRLYAIGGTALSSITDTTTYNAWLSSIDTRPVFCGFTRDSLRPIWELAESPQRQEILQKATKTFIPLEIRRNAIVDVDIIVSDNCWANPPYGYTKIDYDLNRNAKGKYIFLCYNQQKISVAGSPADPKPITALYVASGD

SEQ ID NO: 688 - protein, 340 aa, Huperzia carriata (Solomon Islands)
MAEIKPLPGSDSIGHSYDVFGFFANLKSVKRQLFDFAPQEEITLEGHNWLLSADIEYTAARDTEIKTISDRTTDAYSTELAASVKVSGSYGYFSASVESDFSQSISDETDSTYTSVRTNVTKWKLNLKPTVEELRSMLTPSFKEALASMDSDELFTTYGTYYLSEVLVGGRADYVATTKTSAFSSDTQIGVVAESSFKSVAGMEVSSQYKELIKKFQENSSTSLYAIGGSAISSITDTATYNKWLSSIDTLPVFCGFTSASLMPIWELAESSERQEILQKATKTFIPPEIRQNAIVDVDIIVSDDSSVNPPDGYTKIDYDLNHNAKGKYIFLCYNQQKII

SEQ ID NO: 689 - protein, 343 aa, Huperzia nummulariifolia (Blume)
MRSKLKSDLKEALASMKVCVEGGIGQYESIGVVESVRNKYMGYRYVFVGGRTGQLYVQGVIGRSCSADYVATTKTSAFSSSTKISTVAESSFKSMAGMKVSATHDQLIQTFQENSSTKSSFKSVAGMDVSSKYKELIQIFQENSFTSLYAIGGSALSSITDTDTYNAWLSSIDTLPVFCGFTCESLQPIWELAESPQRQEILQKATMTFIPPEIRRNAIVDVDIIVSDNYSVNPPYGYTKIDYDLNRNAEGKYIFLCYNQQKISVAGSPADPKPITALDVASGDDDDPDVPPGYTRINSDLNEGAGGKYIYLCYTKDPAAIPSDEDGLPILASALSAMKNFRM

SEQ ID NO: 690 - protein, 358 aa, Platycerium bifurcatum
MAQIEPLPGSDAIGHSYDVFGFYANPKSVNTQLFDFAPQQEIILEDHKWLLSTDIEYIAVRETEIKTVSLRTKDAYSTELAASVKVSGSYGSFSASVESDFSQSISDETDSTYTSVRTNVNKWKLSLKPTVEELRSMLTPSFKEALASMDSEELFTTYGTHYLSEVLVGGRADYVATTKTSAFSSDIQISVVAECSFKSVAGMEVSSQYKELIKTFQENSSTRLYAIGGTTISSITDKDTYNAWLSSIDTRPVFCGFTYESLQPIWELAESPQRQEILQKATKTFISPEIKRNAIVDVDIIVSDNYGVNPPYGYTKIDYDLNRNAKGKYIFLCYTEDISSRIPCGSEAHHCFVRGFWR

SEQ ID NO: 691 - protein, 485 aa, Selaginella pallescens
MAEHSEQKGSLILESLEEGRKLPGTEILGSGYDVLGGYYADPRSCLVNLFDFPAEVETVQIGNQEFSKSTGIVYHSSIGTDLDMSSGKSIQEYTKEINSKTKLEGNYSFFSASIEADIGIKSAQKSENEFSKAQYNVKFFTLQLPPHHSKMLKPQIKDDIDNMSDLVRLFDMYGTYYLAGILMGGAASSTSSTSTSTFNSSLDVSVAAKIAFQWSIGGLSAEEQAEYKQQVKSFNESSETTVRTTGGKPGIKFPAEIGEWSDSILDYMAFVDYLGSRSLVGIWELASTRERQDELHKFYHKYCRFRQMQIIPLLRARVVPFAQMSRLGSNLAAWAPDEPDMPFGWYYLGQVWYHTGPYKMVPAVFALIVQEMEPGMLADVRSWSKVGDGPEGSSFWHGSSASEDHLVLGNFFHDKSNPPTALESFGIKAVHMDCLVPANLGYYHNMPGSDVLLGLKVWPVVAADDTAIPMDKLQSCFSLDGPGPF

SEQ ID NO: 692 - protein, 346 aa, Huperzia salvinioides
MTRIPLTLQFVNVNKWKLSLKPTVEELRSMLTPSFKEALASMNSEELFTTYGTHYLSEVLVGGRADYVATTKTSAFSSDIQISVVAESSFKSVAGMDVSSKYKELIQIFQENSSTSLYAIGGSALSSITDTATYNAWLTSIDTRPVFCGFTCESLQPIWELAETSERREILQKATQTFIPLEIKRNAIVDVDIVVSDNHKVNPPYGFTKVDYDLNNNANGKYIYLCYKQQKISVAGSPADPKPITALDVASGDDDDPDVPPGYTRINSDLNEGAGGKYIYLCYTKDPAAIPSDEDGLPIRGIRVIDDEKLENVVTPYGYTRIDEDLNKGAGGDYIFVCFSRHLDSL

SEQ ID NO: 693 - protein, 449 aa, Selaginella pallescens
MSYTSSIVFSFVLAALLFYPFCVQSSNVHIGNGLYLPDTNLMVPINSQYTIFEGDISRFLREEPLGITFNNKVFSRDTESLYREFSQTFGLNAQYRVVQISVEQSLQHIAGSETNVTALSIDVLTYSKKLSIRNEARTITRIPLREAFLQELRQLPEYPADGDNNWLPYLRFMRKWGSHYVNAVYYGSWFQQWSTASSTMRFTERQFQARACVAVEGVGNKFPSVEACAGVGEQEKRAASSLSMRTRLVVRGGEPRTASMLSSGQRTDELLQQFIEEGLDSTVAVRYEFTPLWTQVLADYGMNTREGRIASAMEAYYEGFLAFGCPRMTTTNNIAMQRFRRSVSNLYSCERKCEGCSVAADCNRIGNSQICKCFGNSCIRLIEDNPEDRVEVQTTRDDLRQNEGPNRSCQFSGSSCRCVASAESNCVAGYRAIWNQWDALAEKDAVQVM

SEQ ID NO: 694 - protein, 490 aa, Selaginella victoriae
MVDRAEFMQSSTKVFQFCSFLVLAYYIGYTSCVQNLGHGVYLPDTNLVSNSNPNAPQLIFRENVADFVTNESFSRMVDRAEFMQSSTQVFQFFGISFGMSFPIKKLMFSFDTSFQAISGGRQEIKAAVLQVESYSRRSFFRNNLALQLNPTLVQDLNSLPEPPTITAHRHDWRNHENFLRKWGSHYMTEVRYGSWMRQFTSAASTETYSEIEMKANACARLFGGKLSKIGACAGITQQQINANSNLRVRLTTEVRGGNAQTAAQLRRIPVQESVIESFKVEGRNSNEAVVYHFAPIWQAIKARYSVQTRQWRQADALESFYVGFLAFDCPQRILNTGSSSEPTTLLQQFRRRGEKFQCVRHCVGCRRSKDCNFHTTGNGAPGCYCYGNSCLVAQGAESRIAIQTRRDNLPRNVNPNRSCQQSGVSGCKCDRNPRENGCGADNMIEIWPQTPRNPNPGTLNAYEETGVDIVDDMIMVQEDEVVYDEMKNIM

SEQ ID NO: 695 - protein, 263 aa, Selaginella kraussiana (Variegata)
MVISGAETKAVAAIQALGCGFDVTLDHKLEYAKSRLVDLDPETRTVVVPGNIIVEDVSMDIKVDKGENTRLRTDALDFHQMSERFNQGCGIAGKMPLGLLTAMYDLKGPWQLDALSTKCLAFDGYIAVLYEMKVAKSLISLLREVKDAVPSNWQPLELTRFIEKYGTHVITGVKVGGKDVIYLRQSQSSKLSAVDIQRYLESLAEQRFADGSGRRFKVFKKGAKTKVADPFAMIDRSKVINNFSSISISDDVSTKLSNMATYL

SEQ ID NO: 696 - protein, 486 aa, Platycerium bifurcatum
MALIEPLPGSDAIGHSYDVFGFYANPKSVNTQLFDFAPQQEIILEDHKWLLSTDIEYIAVRETEIKTVSLRTKDAYSTELAASVKVSGSYGSFSASVESDFSQSISDETDSTYTSVRTNVNKWKLSLKPTVEELRSMLTPSFKEALASMDSEELFTTYGTHYLSEVLVGGRADYVATTKTSAFSSDIQISVVAECSFKSVAGMEVSSQYKELIKTFQENSSTRLYAIGGTTISSITDKDTYNAWLSSIDTRPVFCGFTYESLQPIWELAESPQRQEILQKATKTFISPEIKRNAIVDVDIIVSDNYGVNPPYGYTKIDYDLSPEIKRNAIVDVDIIVSDNYGVNPPYGYTKIDYDLNRNAKGKFIYLCYKQQKISVAGSPADPKPITALNVVSSDYHDPSGPSGYTMIYTDLNQGVGGKFIYLCYTKDPAAIPNDEDGLPIRGIRVIGNEKLENVVTPYGYTRIDKDLNEGAGGDFIYVCFSRHLD

SEQ ID NO: 697 - protein, 451 aa, Huperzia phlegmoides
MAQIEPLPGSDAIGHSYDVFGFYANPKSVKRQLFDFAPQQEITEEGHTWLLSTDIVYTAVRDTEIKTVSLRTKDEYSTELAASVKVSGSYGGFSASVESDFSQSISQETDSTYTSVRTNVTKWKLSLKPTVEELRSMLTPSFKEALASMDSEELFTTYGTYYLSEVLVGGRADYVATTKISAFSSDTQISVVAESSFKSVAGMDVPSDYKELIEKFQEKSSTSLYAIGGTALSSITDTATYNAWLSSIDTLPVFCGFTSASLRPIWELAESSQRQQILQKATQTFIPLEIRRNAIVDVAIIVSDNHLVNPPYGFTKIDFDLNRGAKGKFIYLCYKQQKISVAGSPADPKPITALNVVSSDYHDPSGPSGYTMINTDLNQGVGGKFIYLCYTKDPAAIPSDEDGLPIRGIRVIGNPQFGNVVTPYGFTRIDKDLNEGAKGEFIYVCFSRHLD

SEQ ID NO: 698 - protein, 301 aa, Platycerium bifurcatum
MQSDTVMMYSDFTPTPRALIHTSSTLRSRKKSFLRATPVSTDIEYIAVRDTEIKTVSLRTKDAYSSKLAASVKLSGSYGSFSASVESDFSQSISDETDFTYTSVRTNVNKWKLSLKPTVEELRSMLTPSFKEALASMDSEELFTTYGTHYLSEVLVGGRADYVATTKTSAFSSDIQISVVAECSFKSVAGMDVSAKYKELIQKFQENSSTSLYAIGGTALNSSTSLYAIGGTAISSITDTDTYNAWLSSIDTCPVFCGFTYESLQPIWELAESPQRQEILQKATQTFIPLRPKSNEMQSST

SEQ ID NO: 699 - protein, 324 aa, Asplenium australasicum
MSCCCCCCSSSSASADGAVSIGSTVYLPESNLGAPLSPLRISIFEGDISSFLRNQSLHHTYNTQRFQSTSDSVFGELGTTFGLSVPLKVLRLSFSTTFRTIAGSQTNVSSALVLVESYSKRQLILNEQRSIQQIPLRADFLQELRNLPEPPTSITAATQWASYRDFLIRWGSHYASEVYYGSWLRTWATAASTKSYTQRQITAKGCADLTGASPIPTIQGCAGIDTAEMTAASRLDVNVQIEVRGGEPATRAQLTVRRTDQLIQDFVQQGQENDDAAVKYGLVPIWRPILARYHSPSSKEWRVATALEGYYKSTMASWRSLVPT

SEQ ID NO: 700 - protein, 323 aa, Huperzia phlegmaria
MAQIEPLPGSDAIGHSYDVFGFYANPKSVKKELFDFALQKEITLEGHTWLLSTDIEHIAVRDTEIKTVSLRTKDAYSSELAASVKLSGSYGGFSASVESDFSQSISDETDSTFTSVRTKSGSYGSFSASVESDFSQSISDETDSTYTSVRTNVNKWKLSLKPTVEELRSMLTPSFKEALASMNSEELFTTYGTHYLNEVLVGGRADYVATTKTSAFSSDTKISVVAESSFKSVAGMEVSAEQKQLIEKFQENSSTSPYAIGGSALSSITDTASYNAWLSSIDTLPVFCGFTYESLQPIWELAESPQRQEILQSRLLWIHSRQS

SEQ ID NO: 701 - protein, 359 aa, Huperzia phlegmaria
MAQIEPLPGSDAIGHSYDVFGFYANPKSVKKELFDFALQKEITLEGHTWLLSTDIVHIAVRDTDINTVSLRTKDAYSTELAASVKVSGSYGSFSASVESDFSQSISDETDSTYTSVRTNVNKWKLSLKPTVEELRSMLTPSFKEALASMNSEELFTTYGTHYLSEVLVGGRADYVATTKTSAFSSDTKISVVAESSFKSVAGMEVSAEYKELIKKFQENSSTRLYALGGSALSSITDTASYNAWFSSIDTRPVFCGFTRDSLRPIWELAESPQRREILRKAAQTFIPPEITRNAIVGVDIIMSDNYWVNPPYGYTKIDYDLNRNAKGKYIFLCYNQQKIFVGIPCGSDAHHCLVRGFWR

SEQ ID NO: 702 - protein, 313 aa, Platycerium bifurcatum
MSGGYGGFSASVESDFSQSISDETDFTYTSVRTNVNKWKLSLKPTVEELRSMLTPSFKEALASMDSEELFTTYGTHYLSEVLVGGRADYVATTKTSAFSSDIQISVVAECSFKSVAGMDVSAKYKELIQKFQENSSTSLYAIGGTALSVDSLTKVFSPFGNSLNPLSARRSSKRLRPITALYVASGDDDNPYVPPGYTKIDQDLNKDAGGKFIYLSYTKDPAAIPNDEDGLPIRGIRVIGNENIDNVVTPYGFTKIDKDLNEGAGGDFIYVCFSRDHPYVPPGYTRISSDLNEGAGGKIIHTFLQVIPGSTAI

SEQ ID NO: 703 - protein, 282 aa, Huperzia nummulariifolia
MNSEELFTTYGTHYLSEVLVGGRADYVATTKTSAFSSDIQISVVAEIVAENSFKSMAGMENSSEYKELIQKFQENSSTSLSSFKSMAGMENSSEYKELIQKFQENAPLVRTPSVGRALSSIKILPLTTHGSVRLIPFPSSVDSLAQVLGPSGNSLNPLSARRSSKRLSSIDTLPVFCGFTSASLRPIWELAESSQRQEILQKATKTFISPEIKRNAIVDVDIIVSDNYGVNPPYGYTKIDYDLEPQCQGQIYLFVLQSTEDISSRIPCGSEAHHCFVRGFWR

SEQ ID NO: 704 - protein, 592 aa, Selaginella kraussiana (Variegata)
MTDAYEWMKTLPGCDTIGSGYDILNGYYADARSCLENLFDFSSVDNEIVVVSGTQYTKPKVLTYHSSIQTDLHMSEGESIMEYNRSVNMKTKLEGEYNFFSASVELDIGKASAENQENSFSRIQENVSYFTLQLPSSYCDLLIKPRMKKDIDEMTDLTKLFKTYGTHYVSGMIIGGSATYTASTNKTTFKSKLGLGYVAKMSYQALVGGLSAQLESQYGEDIKAFNQASSTKLMAKGGDPAYGGHDFPKHTKEWRNSVKDNLAFVDFLSNRGLTGIWNLASTDARSKQIEGHYAEYCEKSQTNFNMESPLIRAKIVPLTKVQFTDTGSRASLELAVCIPDIGSDWYYLGQVAVPGHNLPKGSTLAVQEIKPGALVKVNRWEKIWDDQGSGARNDYNLWRGLAENPVDYHVLSDFFRGNVDGYNKQEPPTEQDTRGIVAVHSSCVVPAQVGKMIWNAGGTGASNEASVWQIISTTGLANLMDNLSKTTMDTSHVDLGYVGTADISDGELGLPTKPPPGGNVSTAISNGELGLPGGNVRTTDFKPPAPQSSIISNRAESIDTSKILPYYVSTLDNYKPHRPVYLLKKSAVQFVN

SEQ ID NO: 705 - protein, 451 aa, Huperzia carinata
MACIEPLPGSDAIGHSYDVFGFYANPKSVKRELFDFAPQQEITEEGHTWLLSTDIVNTAVRDTEIKTVSLRTKDEYSTELAASVKVSGSYGGFSASVESDFSQSISQETDSTYTSVRTNVTKWKLGLKPTVEELRSMLTPSFKEALASMESEELFTTYGTYYLSEVLVGGRADYVATTKTSAFSSDTQISVVAESSFKSVAGMEVSSQYKELIKKFQENSSTRLYAIGGTALSSITDTATYNAWLSSIDTLPVFCGFTSASLKPIWELAESSQRQEILQKAAQTFIPLEIRRNAIVDVAIIVSDNHLVNPPYGFTKIDFDLNRGAKGKFIYLCYKQQKISVAGSPADPKPITALNVVSSDYHDPSAPSGYTMINTDLNQGAKGKFIYLCYTKDPAAIPSDEDGLPIRGLRVIGNPQVENVVTPYGFTRINKDLNEGAKGEYIYVCFSRHLD

SEQ ID NO: 706 - protein, 296 aa, Huperzia nummulariifolia (Blume)
MLTPSFKEALASMNSEELFTTYGTHYLSEVLVGGRADYVATTQTSAFSSDIQISVVAESSFKSVAGMDVSSKYKELIQIFQENSFTSLYAIGGSALSSITDTDTYNAWLSSIDTLPVFCGFTCESLQPIWELAESPQRQEILQKATQTFIPLEIKRNAIVDVDIVVSDNHKVNPPYGFTKVDYDLNNNANGKYIYLCYKQQKISVAGSPADPKPITALDVASGDDDDPDVPPGYTRINSDLNEGAGGKYIYLCYTKDPAAIPSDEDGLPILASALLVTKNSRMWLHLTDSRRLIKI

SEQ ID NO: 707 - protein, 328 aa, Huperzia squarrosa
MVHIEPLPGSDAIGHSYDVFGFYANPKSVKKELFDFALQKEITSEGHTWLLSTDIEYIAVRDTEIKTVSIRTKDAYSSELAASVKLCGSYGGFSASVESDFSESISDETDSTYTSVRTNVNKWKLSLKHTVEELRSKLKPALKEALASMKAVELLSTYGTHYMAEVLVGGRADYVATTKNSAFSSDTKISIVAESSFKSVAGMKVSAEQKQLIEKFQENSSTSLYAIGGSALSSITNTATYNAWLSSIDTRPVFCGFTRDSLRPIWELAESPRRREILRTATQTFIPSGITRNAIVGVDIIVSDNYSVNPPYGYTRRSYDPIRRSIMI

SEQ ID NO: 708 - protein, 380 aa, Selaginella victoriae (LW10887)
MRNFKKGARKKVADPIASLDRSRLSSNYGSAFMSSNNVEVMFRRRGGLDSKKDHSSWLASVPERPEVISMSFVPITSLLSGVPGAGFLTHAINLYLRYKPPLEELHYFLEFQIPRQWTPPLELPSNVSNSGLPVLQFSPFGAKLYVSLEEATVGRLPVTGLRLYIQGKRRNRLSVHLQYLASLPRILASHWGTNVYSETPVWMKSEDNPKWFLPVQWKSYSQVNTAPVEFGASYIGDKGAAFVVTGAQLQVSTHKTRNVLYLGLQFTRIPGCSVRRSAWDNMPTASQKSGSGFFSQLGLSTTLSTLNASPAPERFVQNSAVFSGEPSVSTKNSKMRKYVDITEMSKGIQDQPGHWIISGGKLDVENGKIFLKVKYSLLKY

SEQ ID NO: 709 - protein, 252 aa, Huperzia nummarifolia
MAGVKVSAAQKQLINKFQENSSTRLYAIGGSALSSITDTATYNAWLSSIDTLPVFCGFTSASLLPIWELAESSQRQDILQKATQTFIPLEIRRNAIVDMDIIVSDNYVVNPPYGFTKIDYDLNRNAKGKYIFLCYKQQKISVAGSPADPKPITALYVTSGDDYNPYVPPGYTKIDKDLNKDAGGKFIYLCYTKDPAAIPNDEDGLPIRGIRVIGNEKLENVVTPYGYTRIDQDLNKGAGGDYIFVCFSRYVD

SEQ ID NO: 710 - protein, 362 aa, Selaginella biformis
MGGHATYTSSTNKNEFSSEFELGLVASMSFKALVGSISVYDTYGTHYLRTIVMGGHATYTSSTNKNEFSSEFELGVVASMSFKALVGSISASEEAKYTSSIQSFNESSTTKIETSGGDPGLGGTYFAKHVDEWINSVKDYMTLADFVHGETVPLWRLASTAEREDALQKHYLDYCKRKQTTYTLSGIPPLRVRRVPVTEGFQPYYHVGTPDIGGNWSYFGQTNGYGYTIVVQETQPGSGVLGRIAKWEKIGDVYGCSVWRGVPADPVDYVVLSDFTHRGSNAPTAEETVGIMAVHRSCLISIGSGSGLDNPSWDFCMWGVDPVYNPKVSLLEDLKLYVMVIFSGQGTREMYRLLASELQVED

SEQ ID NO: 711 - protein, 295 aa, Huperzia nummulariifolia (Blume)
MACIEPLPGSDAIGHSYDVFGFYANPKSVNSQLFDFAPQQEIILEDHKWLLSTDIVYVAVRDTDIKTVSLCTKDEYSTELAASVKLSGSYGSFSASVESDFSQSISDDTDSTYTSVRTNVNKWKLSLKPTVEELRSMLTPSFKEALASMNSEELFTTYGTHYLSEVLVGGRADYVATTQTSAFSSDTKISIVAESSFKSVAGMKVSAEQKQLIEKFQENRSTSLYAIGGSALSSITDTATYNAWLTSIDTRPVFCGFTRDSLRPIWELAESPQRREVLRKAAQTYIPPHEMPSLA

SEQ ID NO: 712 - protein, 300 aa, Tupidanthus calyptratus
MEPRKNMSSDALNTTLWNSIQALGRGFDVTSDIRLLYCKGIPGSRLVQINDRDAKDLRVSDEFVVPNVSVDIECSKGEKITETTPVCSFHEMAIYFNEKSEISGDVPLGSFNAMFNLTGSWQLDAATTKSLAMIGSVIPLYKVELANLDLVLNEEVKRAVPYSWDPASLASFIENYGTHIVTSATVGGRDVVYIRQHQSSPLSVSDIENYVKDIADQRYSESRSHPSAAPLKYKDKDVTVIFRRRGGDDLEQSHIRWAETVQTSPDVINMTFIPIVSLLEGVPGIKHLACAIELYLECKI

SEQ ID NO: 713 - protein, 583 aa, Equisetum arvense
MAEDEDPVVEPCQSLAASSIQAMGRGFDLTCDIRLSYCKGVSPLVHLDQQNKKDLRLPGGISIPDAPAEIQCLHGRTSHHGTNTLNFDQMSERFNKALSIEGKIPSGLFNAMFSFSGSWRADASTTKSLALDGWFSTLYNLKLAKHSLKLHDEVKREVPSTWDPEALASFIEKHGTHIVTSVTVGGKDTIYVKQHQSSSLTSIEIESYLKELGDRRFLAGSSNPALDLNDKAAGQSSPLTGPNLVQTLGSDGPSSLTGKEDVTVIYRRRGGDDLVQNHEEWKDTIKSNPDVISMTFIPITSLLEGCPGKEHLIRAIDVYLEYKPPIEELQYFLEFQVTKVWAPVQNDGRLPRKEPICPSLQFSLMGPKLFINTEQVSVGRRPVTGLRLSLEGTKANRLCIHIQHLVALPKILRPHWDSYVAIGALKWHGPEEQDSRWFEPIQWKNFSHVSTAPIEFNEAWMVDLSGAHVVTGAQLGVWDFGPKSVLYLRLLYSKVPGCTIRRSVWDHNPVSYHHSDASKDIINNSPVSSSGALQVNKLVKFVDTEEMTRGPHDMPGHWLVTGAKLGVEKSRIFLRAKYSLLNY

SEQ ID NO: 714 - protein, 588 aa, Adiantum hispidulum
MAVDGASYRGAHSTALNALQALGRGFDVTCDIRLLHCKGSPGSRLVVVDDEHTAELKVLDSLGIPKVSTDIRARPEKPSRPSLGVQDFDQMSELFNKKLCIGGKIPSGIFNAMFSFSGSWQVDAAMTKSLALDGVSLPLYSVHLRPPFILREEVEKAVPSAWDPAALASFIEKYGTHIIMSVEVGGKDIVYVKQHQSSSLTKTEVELQLRKLVETRFQGTETSIAEVENKFQELPPLSSHKNHSKTVHAEGSSSLTGKEDITVIYRRRGGDDLVQDHLEWKKTVYTNPDVLSMSFFPISALLDPGPRRENLMRAIEAYTIYKPPLEELQYFLEFQVPRAWAPVTNQLGVPRKEPVCPSLQFSLMGPKLFINTDQVSVGRKPVTGLRLCLEGSKLNRLAVHVQHLTVLPKILQPHWDAYVTIGAPKWHGPEEQDSRWFEPVLWKNFAHVSTAPVEFSETWFGDASGAYIVTGAQLGVWDFGMKSVLHLKLLYSKVPDCTIRRSVWDQLPNGLQQSKGKKGTSSASSPAVSSDGTSSATQTSMKLSKFVDTTELARGPQDLPGHWLVTGAKLGVEKSNVFLRVKYSLLNY

SEQ ID NO: 715 - protein, 368 aa, Tupidanthus calyptratus
MEPRKNMSSDALNTTLWNSIQALGRGFDVTSDIRLLYCKGIPGSRLVQINDGVTKDLAVSDGFVVPNVSVDIESSRGEEVTETTAVCSFHEMAIYFNEKSEISGHVPLGSFNAMFNLTGSWQLDAATTKSLAMIGSVIPLYKVELANLDLVLNEEVKRAVPYSWDPASLASFIENYGTHIVTSATVGGRDVVYIRQHQSSPLSVSDIENYVKDIADQRYSGSRSNPSAAPLKYKDKDVTVIFRRRGGDDLEQSHVRWAETVQTSPDVINMTFIPIVSLLEGVPGIKHLACAIELYLEYKPPIEDLQYFLEFQIARVWAPEQSNIQRKDPVCPSLHFSLMGPKLYISPDQVPCLVFNTLLLNCCYEPMV

SEQ ID NO: 716 - protein, 300 aa, Tupidanthus calyptratus
MEPRKNMSSDALNTTLWNSIQALGRGFDVTSDIRLLYCKGIPGSRLVQINDRDAKDLRVSDEFVVPNVSVDIECSKGEKITETTPVCSFHEMAIYFNEKSEISGHVPLGSFNAMFNLTGSWQLDAATTKSLAMIGSVIPLYKVELANLDLVLNEEVKRAVPYSWDPASLASFIENYGTHIVTSATVGGRDVVYIRQHQSSPLSVSDIENYVKDIADQRYSGSRSNPSAAPLKYKDKDVTVIFRRRGGDDLEQSHVRWAETVQTSPDVINMTFIPIVSLLEGVPGIKHLACAIELYLECKI

SEQ ID NO: 717 - protein, 580 aa, Lygodium flexuosum
MAEEDILFRGARSTALNAIQALGRGFDVTCDIRLLYCKGTAGTHLVKVDEDHKGDLELPKGLRIPNVSIDIKARPEKCTRHSLGVLEFDQMSEAFNKLLAIPGKTPLGMFNAMFSFSGSWQADAASTKRLAVDGWIIPLYSVHLRPPFILCEEVKKTVPSSWDPAALASFIEKYGTHIIISVEVGGKDVIYVKQHQSSTLSKSEIEMHLKRLVETRFHGAQNSYMETEEKVEEPAIFTSHKIRSQPTHADSSSSLTGKEDITVIYRRRGGDDLIQDHFEWRDSIFGNPDVLTMSFFPIVLLLDSGSGMENLTRAIEAYLKYKPPLEELQYFLEFLAPRAWAPVASQVGPPRKEPVCPFLQFSLMGQKLFISTDQVSVGRKPITGLRLSLEGSKLNRLAVHVQHLTVLPKILQPHWDAYVAIGAPKWHGPEEQDSRWFEPVQWKNFAHVSTAPVEFSETWFGDASGAYIVTGAQLGVWDFGLKSVLHLKLLYSKVPGCTIRRSVWDHTPLPPSQQAKSNNSTASTVPAATTQTQKLLKFVDTSEMSRGPQDVPGHWLVTGAKLCVEKNKIFLRVKYSLLNY

SEQ ID NO: 718 - protein, 570 aa, Asplenium australasicum
MADEDSSLRGAFATAVNAVQALGRGFDVTCDIRLLYCKGALGSRLVVIDDDHTADLKLSDGLVIPNVSMDIRARLEKPSCPSLGVQGFDEMSEEFNKKLFIGGDIPSGMFNAMFNFSGSWQVDSSLTKRLAVDGLVLPLYSVHLRSPFILCEEVKNAVPNTWDPAALASFIEKYGTHIIRSVEVGGKDTIYVKQHPSSTLTKEEVESHLTKLVESRFQGRESDVIRRKDKENTDSSSSLTGKEDITVIYRRRGGDDLVQDHVDWKKTVNFNPDILSMAFFPIVLLLDPGTGREHLNRAIEAHLKYKPPLEELHYLLEFHVTRAWAPLANPAGPSRKEPVCPALQFSLMGPKLFINMSQVSVGRKPVTGLRLCLEGSKLNRLAVHVQHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHAPIGGQQQSKAKGASSASPAALDAAAAATQATQKLSKFVDTSEMARGPQDLPGHWLVTGAKLCVEKSNIFLRVKYSLLNY

SEQ ID NO: 719 - protein, 551 aa, Lygodium flexuosum
MAEEDILFRGARSTALNAIQALGRGFDVTCDIRLLYCKGTAGTHLVKVDEDHKGDLELPKGLRIPNVSIDIKARPEKCTRHSLGVLEFDQMSEAFNKLLAIPGKTPLGMFNAMFSFSGSWQADAASTKRLAVDGWIIPLYSVHLRPPFILCEEVKKTVPSSWDPAALASFIEKYGTHIIISVEVGGKDVIYVKQHQSSTLSKSEIEMHLKRLVETRFHGAQNSYMETEEKDITVIYRRRGGDDLIQDHFEWRDSIFGNPDVLTMSFFPIVLLLDSGSGMENLTRAIEAYLKYKPPLEELQYFLEFLAPRAWAPVASQVGPPRKEPVCPFLQFSLMGQKLFISTDQVSVGRKPITGLRLSLEGSKLNRLAVHVQHLTVLPKILQPHWDAYVAIGAPKWHGPEEQDSRWFEPVQWKNFAHVSTAPVEFSETWFGDASGAYIVTGAQLGVWDFGLKSVLHLKLLYSKVPGCTIRRSVWDHTPLPPSQQAKSNNSTASTVPAATTQTQKLLKFVDTSEMSRGPQDVPGHWLVTGAKLCVEKNKIFLRVKYSLLNY

SEQ ID NO: 720 - protein, 306 aa, Celosia argentea (Sylphid)
MTVKSSPDIIEMTFVPITDLIKDSARKEYLSRAINLYLEYKPAIEELRYFLEFQIPRVWAPVHNRLLRHQRKEPVCPSLQFSLMGQKLYISQEQVSVGRKPVTGLRLFLEGAKQNRLCIHLQHLASLPKILVPCWDTHVAIGAPKWMGPEEQDSRWFEPVKWKNFSHVSTAPIESHESFAGEVSGVHIVTGAQLGVWDFGSRNVLYMKLLYSRLPGCTIRRSLWDHTPIEKPWKAGGSAESTSGDSSSGGLSESVSSGNKLAKFVDMSEVTKGPEDLPGHWLVTGGKLGIEKGKIVLRVKYSLLNY

SEQ ID NO: 721 - protein, 493 aa, Ophioglossum pendulum
MAGYFNEVLSLSGKTASGVFNAVFNFSGSWNSDALATKSLAVDGWSIILYSLSLTRAPLTLIHEVKAAVPYTWDPAALASFIEKYGTHIVTSVSVGGKDAIYVKQHQSSTLTSTDVELHLKELRSIRFSPYGGHISFLGNEKVADQMLFSTQQILPQPCNSNGSSSFAGKEDITVIYRRRGGNDLVQGHDEWKKTVPTNPDVVTMTFVPITSLLENGPRSDHLSRAILVYLEYKPPIEELQYFLAFQVARVWAPVQNELGPPRREPVCPALQFSLMGPKLYISTEQVSVGRRPVTGLRLSLEGRNCNRLAVHVQHLTSLPKVLQPHWDAYIAIGAPKWHGPEEQDSRWFEPVLWRNFSHISTAPVEFNETWIGDASGAFVVTGAQLGVWDFGLKSVLYLRLLYSKVPGCTIRRSVWDHTPVSLNQNLKMDSSKVLNTVPTATSQTPKLLKFVDTTEMSRGAQDMPGHWLVTGAKLGVDKSKIFLRVRYSLLNY

SEQ ID NO: 722 - protein, 254 aa, Stenochiaena tenuifolia
MADKDASSRGARGTAVNAVQALGRGFDVTCDIRLLYCKGAPGSRLVIIDDDHTADLKLSDSLVIPKVSKDIKARLDKPYCPSPGAQDFDQMSELFNRKLGIGGRIPSGMFNAMFNFSGSWQVDASMTKSLAVDGVFIHLYSVHLKAPFILCEEVKKAVPSTWDPAALASFIEKYGTHVIIGVEVGGKDIIYVKQHQSSSLTKSEVDLHLKKLVEMRFQGKESKELALNPQKNRSQFVHADSSSSLTGKEDITVI

SEQ ID NO: 723 - protein, 581 aa, Equisetum arvense
MAEDEPSRTLGTNVIQALGQGFDITSDIRLSYCKGSRLVQIDAEQTSDLVLPGVTASIPQVPTEIQCLPGRTMRHGTGVLDFEKMAQRFNKALSVNGKIPSGLFNAMFSFSGSWRADAHVTKSLALDGWFIMLYNLKLAHSSFKLRGEIKREVPSTWDPSALSSFIERHGTHIVTSVTVGGKDAIYVKQHQSSSLTSMEIESYLKELGDRRFLARSKHSAFEMKEKGAGQSFPPPAQSLLPTSASDSSSSLTGKEDVTVIYRRRGGDDLEQNHEEWKYTIFSNPDVISMTFIPIASLLEGCPGKEHLIRAIDVYLEYKPPIEELQYFLEFQVAKAWAPVQNEGRLPRKEPVCPSLQFSLMGPKLYINTEQVSVGRRPVIGLRLCLEGSKVNRLSVHVLHLVALPKLLQPHWDSYVAIGPPKWHGPEEQDSRWFEPIQWKNFSHVSTAPIEYSEGWMGDVSGAHVVTGAQLGVWDFGPKSVLHLRLLYSKVPGCTIRRSIWDYNPNPSSFNPSTNPSKASKEVNASSSSNAPQVNKLTKFVDTEEMVKGPQDMPGHWLVTGAKLGVEKSKIFLRVKYSLLNY

SEQ ID NO: 724 - protein, 585 aa, Polystichum polyblepharum (C.)
MADEDASFRGAHGTAVNAVQALGRGFDVTCDIRLLYCKSTPGSRLVVINDDHTANLNVSDGLVIPNVSKDIKARLEKPFRPSHGVQDFDQMSELFNKKLGIGGKIPSGMFNAMFNFSGSWQVDSSITKSLSVDGVVIPLYSVHLRPPFILREEVKMAVPSTWDPPALASFIEKYGTHIIISVEVGGKDTIYVKQHLSSSLTKSEVDSHVKKLVETRFQGMESGVTQAKDKFQELALTNPQKNRSQLVHDDGSSSLTSKEDITVIYRRRGGDDLVQDHLEWKKTVNTNPDILSMAFFPIVVLLDAGSGREHLNRAIEAHLQYKPPLEELQYFLEFQVTRAWAPVANQVGLPRKEPVCPSLQFSLMGPKLFISTDQVSVGRKPVTGLRLCLEGSKLNRLAVHLQHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHTPIGQQLSKAKKGTSSATAAAAAAATVTQTTQKLSKFVDTTEMARGPQDLPGHWLVTGAKLCVEKSNIFLRVKYSLLNY

SEQ ID NO: 725 - protein, 361 aa, Ophioglossum pendulum
MEDDDSALKVSIAVNALQTLGRGFDLTCDIRIIYCKGTEGSRLLEIDEEHTKNLELPGGISIPDVSRDIKCVQGTEKHFSTGVLHFEQMAGYFNEVLSLSGKTASGVFNAVFNFSGSWNSDALATKSLAVDGWSIILYSLSLTRAPLTLIHEVKAAVPYTWDPAALASFIEKYGTHIVTSVSVGGKDAIYVKQHQSSTLTSTDVELHLKELRSIRFSPYGGHISFLGNEKVADQMLFSTQQILPQPCNSNGSSSFAGKEDITVIYRRRGGNDLVKGHDEWKKTVPTNPDVVTMTFIPITSLLEDGPCKDHLNRAILVYLEYKPPIEELQYFLAFQVARVWAPVQNELGPPRREPVCPALQL

SEQ ID NO: 726 - protein, 566 aa, Rumohra adiantiformis
MADEDASFRGARGTAVNAVQALGRGFDVTCDIRLLYCKGTPGSRLVVIDDNHTTNLKVSDGLVIPDVSTDIKARLEKPSRPSLGVQDFDQMSELFNNKLGIGGKIPSGMFNAMFNFSGSWQVDSSITKGLALDGVFIPLYSVHLRSPFILRDEVKMAVPSTWDPPALASFIEKYGTHIIISVEVGGKDIVYVKQHPSSSLTKSEVDSHLRKLVETRFQGMESGVNQAKDKFQLVHADGSSSLTGKEDITVIYRRRGGDDLVQDHLEWKKTVNLNPDILSMAFFPIVLLLDAGSGREHVNRAIEAHLKYKPPLEELQFFLEFQVSRAWAPAANQVGLPRKEPVCPSLQFSLMGPKLFISTDQVSVGRKPVTGLRLCLEGSKLNRLAVHLEHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHTPLGQQLSKEKKGTSSAAATATQTTQKLSKFVDTTEMARGPQDLPGHWLVTGAKLCVEKSNIFLRVKYSLLNY

SEQ ID NO: 727 - protein, 429 aa, Platycerium wandae
MANEDVSRGARATAINAVQAIGRGFDITCDIRLLYCKGTPGSRLVVIDDDHTADLQVADDLVIQNVSKDIKARIEKPSRAYQGILDFDQMSELFNKKLSIDGKVPSGMFNAMFNFSGSWQVDSSSTKSLATDGMHIPLYSVHLRPPFILCEEVKRAVPSTWDPPALASFIEKYGTHIIRSVEAGGKDIIYMKQHSSSILSKTEVETHLKKLVEARFQDLDLQSNDEELKLSNPQKHRSQLVHADGSSSLTGKEDITVIYRRRGGDDLVQDPREWKKTVKSNPDILTMSFFPIVLLLDPGPGREHLNRAMDAHLKYKPPLEELQYFLEFQVTRAWAPVANQVGLPRKEPVCPSLQFSLMGPKLYISTDQVSVGRKPVTGLRLCLEGSKLNRLAVYVEHLTVLPKILQPHWDAYVAIGAPKWHGPEEQDST

SEQ ID NO: 728 - protein, 416 aa, Tupidanthus calyptratus
MEENAAALHTAMNSVQALGRGFDVNFDIRLLYCKGVAGSRIVEIDEEHTRDMCLYDGLVVPNVSKDVHNSQETIGRDGSGVCNYFEMVEYINKKANLSENVPVGCFNAAFNFTGCKHIDAAATKTLCLDGFFIPLAKVQLVKSATKTLCLDGFFIPLSKVQLIMSQLVLQENVIRAVPASWDPPALASFIENFGTHVIVSVTIGGKDVIYVKQHQSSSLSKVEIKNYAQDIGNQRFSTTENHTISGLLKYKDKGVDPSLYNSQGVHPQPSTATSLIGNGKEDVTVIFRRRGGDDLEQSHTQWARTVRSSPDVIEMSFFPIIPLLEGVTGKEHLAQAIDLYLEYKPQIEELRYFLEFQVPRIWAPIQDRPPGYQRKEPVCPIFAVQHDGAKALHQPRASTFLCLCEHVTVLVKTGLH

SEQ ID NO: 729 - protein, 572 aa, Asplenium nidus var plicatum
MADEDSSLRGAFATAVNAVQALGRGFDVTCDIRLLYCKGTPGSRLVVIDDDHTADLKLSDGLVIPNVSMDIRARLEKPSRPSLGVQGFDEMSEEFNKKLSIGGNIPSGMFNAMFNFSGSWQVDSSLTKRLAVDGLVLPLYSVHLRSPFILCEEVKKAVPNIWDPAALASFIEKYGTHIIRSVEVGGKDTIYMKQHPSSTLTKEEVESHLKKLVESRFQGRESDVIRRKDKENTDSSSSLTGKEDITVIYRRRGGDDLVQDHVEWKKTVNFNPDILSMAFFPIVLLLDAGSGREHLNRAIEAHLKYKPPLEELHYFLEFQLTRAWAPLVNPAGPPRKEPVCPALQFSLMGPKLFINTSQVSVGRKPVTGLRLSLEGSKLNRLAVHVQHLAVLPKILQPHWDAYVAIGAPKWHGPEEQDSRWFEPVLWKNFAHVSTAPVEFSETWFGDASGAFIVTGAQLGVWDFGLKSVLHLKLLYSKVPGCTIRRSVWDHAPIGGQQQGKAKGASSASPAAPDAAAAAAATQATQKLSKFVDTSEMARGPQDLPGHWLVTGAKLCVEKSNIFLRVKYSLLNY

SEQ ID NO: 730 - protein, 381 aa, Pandorea pandorana (Golden Showers)
MGENAAALHTAINSVQALGRGFDVNYDTRLLYCKGVAGSRIVDIDEEHPRDLYLSDNLVVPDVSREIKNSQEAGGRDGFGVCSYNEMAEYFNKKASLSGHTPLGSFNAAFSFTGSRHIDASSTKSLCMDGFFIPVAKIHLGNSPMVLNENVRRAVPKSWDPPALASFIENFGTHVITSVTIGGKDVIYVKQHLSSPLSIVEIKNYVQDIGNQRFSSTEGITSSGPLKYKDKGSDPSLFNSQGIYPQPASAPYLSGNGKEDVTVIFRRRGGDDLEQSHTQWAKTVQSSPDVIEMSFFPITELLDGVRGKEHLARAIALYLENKPQIEELRYFLEFQVPRIWAPVQDRFPGQQRKEPVCPSLQFSMMGQKLYVSQEQVRVLIY

SEQ ID NO: 731 - protein, 471 aa, Tupidanthus calyptratus
MEENAAALHTAMNSVQALGRGFDVNFDIRLLYCKGVAGSRIVEIDEEHTRDMCLYDGLVVPNVSKDVHNSQETIGRDGSGVCNYFEMVEYINKKANLSENVPVGCFNAAFNFTGCKHIDAAATKTLCLDGFFIPLAKVQLVKSQLVLQENVIRAVPASWDPPALASFIENFGTHVIVSVTIGGKDVIYVKQHQSSPLSKVEIKKYVQDIGNQRFSTTENHTISGLLKYKDKGVDPSLYNSQGVHPQPSTATSLIGNGKEDVTVIFRRRGGDDLEQSHTQWARTVRSSPDVIEMSFFPIIPLLEGVTGKEHLAQAIDLYLEYKPQIEELRYFLEFQVPRIWAPIQDRPPGYQRKEPVCPSLQFSMMGQKLYISQEQVSVGRKPVTGMRLCLEGSKQNRLIIHLQHLACLPKILQPYWDTHVSIGAPKWQGPEEQDSRWFEPVKWKNFSHVSTAPIECPETFVGDQSGCQAAR

SEQ ID NO: 732 - protein, 581 aa, Asplenium antiquum (Crissie)
MADEDASSRGALVTAVNAVQALGRGFDVTCDIRLLYCKGTPGSRLVVVDDDHNTYLRVSDGVVIPNVSADIRARLEKPSRPTLGVQGFDEMSEEFNKKLFIGGNIPSGMFNAMFNFSGSWQVDSSMTKSLAIDGLVLPLYSVHLRSPFILCEELKNAVPNTWDPAALASFIEKYGTHIIRSVEVGGKDIIYVKQHPSSTLTKHEVESHLKKLVESRFQAMESDVIWRKDKENTESSSSLTGKEDITVIYRRRGGDDLVQDHVEWKKTVNSNPDILSMAFFPIVLLLDPGTGREHLNRAIEAHLKYKPPLEELHYFLEFHVTRAWAPLANPVGPPRKEPICPALQFSLMGPKLFINTSQVSVGRKPVTGLRLCLEGSKLNRLAVLVQHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHTPIGQQQSKAKGASSASPATGSAAPDAVGASVAAAAAAATQATQKLSKFVDTSEMARGPQDLPGHWLVTGAKLCVGKSKIFLRVKYSLLNY

SEQ ID NO: 733 - protein, 505 aa, Davallia fejeensis
MFLRTLRQGWRNHLVPIRACKISIRCQSCSTRSCLLKERFRQEWQVDSSITKSLAIDGMHIPLYSVHLRSPFILCDEVKRAVPSTWDPPALASFIEKYGTHIIRSVEVGGKDIIYVKQHPSSNLTKSEVETHLKKLVETRFQGMESGLVHQKDEKNRSQLVHADGSSSLTGKEDITVIYRRRGGDDLVQDPLEWKKTVNSNPDILTMAFFPIVLLLDPGPGREHLHRAIEAHLKYKPPLEELQYFLEFQVTRAWAPLSNQVGLPRKEPVCPSLQFSLMGPKLFISTDQVSVGRKPVTGLRLCLEGSKLNRLAVHVEHLTVLPKILQPHWDAYVAIGAPKWHGPEEQDSRWFEPVLWKNFAHVSTAPVEFSETWFGDASGAYIVTGAQLGVWDFGVKSVLHLKLLYSKVPRCTIRRSVWDHTPIGQQLSKAKKGASSTAAAAVAAAASIGAAATSQAMQKLSKFVDTTEMSRGPQDLPGHWLVTGAKLCVEKSNIFLRVKYSLLNY

SEQ ID NO: 734 - protein, 581 aa, Doellingeria umbellata
MEDNAAALHTAKNAVQALGKGFDVNFDTRLLYCKGVAGSKVVEIDEEHKRDLWLYDNLVVPDVSRDIENYQEPVNRNSSGVCNYHEMVEYFNKRANLAGNVPLGSFNAAFSFTGSKHIDAAATKTLCMDGHFIPLSKFELTKSSLVLQESVKRAVPISWDPPALASFIENFGTHVITSVTIGGKNVIYVKQHLSSPLSTVEIKNYVQDIGNQRFTNTENLTDSGLLRYKEKGGDPSLFSSQGIYPQPTNASSLSGNAKEDVTVIFRRRGGDDLEQSHTKWEKTVKYSPDVIGMQFVPIASLLEGLPGKEHLTRAISLYLEYKPQIEELRYFLEFQVPRVWAPLQDRLPGHQRKEPVCPSLQFSMMGQKLYVSQDQISVGRKPVTGIRLFLEGSKHNRLSIHIQHLQSLPKILRPYWDTHVAIGAPKWLGPEEQDSRWFEPVKWKNFSHVSTAPIESPEAFIGDMCGVHIVTGAQLGVWDFGSRNVLYMKLLYSRLPGCTVRRSLWDHSPNDKSKRSTGHGNSVGDSSSGSGNNNKLAKFVDMTEMSKGPADPPGHWVVTGGKLGVEKGKIVLRLKYSLLNY

SEQ ID NO: 735 - protein, 435 aa, Platycerium bifurcatum
MANEDVSRGARATAINAVQAIGRGFDITCDIRLLYCKGTPGSRLVVIDDDHTADLQVADDLVIQNVSKDIKARIEKPSRAYQGILDFDQMSELFNKKLSIDGKVPSGMFNAMFNFSGSWQVDSSSTKSLATDGMHIPLYSVHLRPPFILCEEVKRAVPSTWDPPALASFIEKYGTHIIRSVEAGGKDIIYMKQHSSSILSKTEVETHLKKLVEARFQDLDLQSNDEELKLSNPQKHRSQLVHADGSSSLTGKEDITVIYRRRGGDDLVQDPREWKKTVKSNPDILTMSFFPIVLLLDPGPGREHLNRAMDAHLKYKPPLEELQYFLEFQVTRAWAPVANQVGLPRKEPVCPSLQFSLMGPKLYISTDQVSVGRKPVTGLRLCLEGSKLNRLAVHVEHLTVLPKILQPHWDGASSLSGRKQAKSACRPCRAPYCAS

SEQ ID NO: 736 - protein, 365 aa, Asplenium prolongatum x Asplenium antiquum (Kurata)
MESDVNQRKDKENSESSSSLTGKEDITVIYRRRGGDDLVQDHVEWKKTVNFNPDILSMAFFPIVLLLDPGTGREHLNRAIEAHLKYKPPLEELHYFLEFHVTRAWAPLANPVGPPRKEPICPGLQFSLMGPKLFINTSQVSVGRKPVTGLRLCLEGSKLNRLAVHVQHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHTPIGQQQSKAKGASSASPAAGTAAPDAAAASVAAAAATQATQKLSVCGYVRDGQRPTRPAWPLASHWRKAVRGEEQNLSESEVLSSELLEAKWP

SEQ ID NO: 737 - protein, 421 aa, Verbascum chaixii (Vill)
MRSKLEILRFLDLMRSLMFLLTLNALKGRVLITRHLFGAFMSFIENYGTHIVTSATIGGRDVVYIRQHQSSPLSASDIENYVKDIGDQRFSDSKGNSSAGALKYKDKDVTVIFRRRGGDDLEQSYAKWAKTVEGAPDVITMTFTPIVSLLEGVAGIKHLARAIELYLEYKPPIEDLQYFLDFQISRAWAPEQNNNLQRKEPVCSSLQFSLMGPKLYISPDQVTVGRKPVTGLKLSLEGLKQNRLAINLQHLVSLPKILQPHWDTHIAIGAPRWQGPEEQDSRWFEPIKWKNFSHVSTSPIECTDTCIGDLSGVHIVTGAQLGVWDFGARSVLHLKLLFSKVPGCTIRRSVWDHSPSNLQKGDGSSSSNESSQMGKLAKIVDMTEMSKGPQDMPGHWLVTGAKLGVDKGKIVLRVKYSLLNY

SEQ ID NO: 738 - protein, 493 aa, Ophioglossum pendulum
MAGYFNEVLSLSGKTASGVFNAVFNFSGSWNSDALATKSLAVDGWSIILYSLSLTRAPLTLIHEVKAAVPYTWDPAALASFIEKYGTHIVTSVSVGGKDAIYVKQHQSSTLTSTDVELHLKELRSIRFSPYGGHISFLGNEKVADQMLFSTQQILPQPCNSNGSSSFAGKEDITVIYRRRGGNDLVKGHDEWKKTVPTNPDVVTMTFIPITSLLEDGPCKDHLNRAILVYLEYKPPIEELQYFLAFQVARVWAPVQNELGPPRREPVCPALQFSLMGPKLYISTEQVSVGRRPVTGLRLSLEGRNCNRLAVHVQHLTSLPKVLQPHWDAYIAIGAPKWHGPEEQDSRWFEPVLWRNFSHISTAPVEFNETWIGDASGAFVVTGAQLGVWDFGLKSVLYLRLLYSKVPGCTIRRSVWDHTPVSLNQNLKMDSSKVLNTVPTATSQTPKLLKFVDTTEMSRGAQDMPGHWLVTGAKLGVDKSKIFLRVRYSLLNY

SEQ ID NO: 739 - protein, 612 aa, Sphaeropteris cooperi
MAEDDTSFRGARATALNALQALGRGFDVTCDIRLLYCKGAPAGARLVKIDEENCWDLALSDGLRIPNVSVGIKARQEECKRLSLGVSDFDQMSELFNRKLGIMGKTPLGMFNAMFSFSGSSQIDASMTKSLAVDGWVIPLYSVHLRAPFMLCEEVRKAVPTTWDPSALASFIEKYGTHIIIGVEVGGKDVIYVKQHQSSILTKSEIELHLKRLVETRFQGVENSVFKAEDKLQELAMFTTQKIRSQPLHADGSSSLTGKEDITVIYRRRGGDDLVQDHFEWRKTVHSNPDVLSMSFFPIVGLLEPGSNVDNLNRAIDAYLTYKPPLEELQYFLEFQVPRAWAPVVNQVGPPRKEPVCPPLQFSLMGPKLFISTDQISVGRKPVTGLRLCLEGSKLNRLAIHLQHLTVLPKILQPHWDLEGSKLNRLAVHVQHLTVLPKILQPHWDAYVAIGAPKWHGPEEQDSRWFEPVLWKNFAHVSTAPVEFNETWFGDASGAYIVTGAQLGVWDFGLKSVLHLKLLYSKVPGCTIRRSVWDHTPAPSGQQQQPKAKKGALSISSAAVPQTTQKLSKFVDTTELMRGPQDLPGHWLVTGAKLCVEKSNIFLRVKYSLLNY

SEQ ID NO: 740 - protein, 584 aa, Tupidanthus calyptratus
MEENAAALHTAMNSVQALGRGFDVNFDIRLLYCKGVAGSRIVEIDEEHTRDMCLYDGLVVPNVSKDVHNSQETIGRDGSGVCNYFEMVEYINKKANLSENVPVGCFNAAFNFTGCKHIDAAATKTLCLDGFFIPLAKVQLVKSQLVLQENVIRAVPASWDPPALASFIENFGTHVIVSVTIGGKDVIYVKQHQSSPLSKVEIKKYVQDIGNQRFSTTENHTISGLLKYKDKGVDPSLYNSQGVHPQPSTATSLIGNGKEDVTVIFRRRGGDDLEQSHTQWARTVRSSPDVIEMSFFPIIPLLEGVTGKEHLAQAIDLYLEYKPQIEELRYFLEFQVPRIWAPIQDRPPGYQRKEPVCPSLQFSMMGQKLYISQEQVSVGRKPVTGMRLCLEGSKQNRLIIHLQHLACLPKILQPYWDTHVSIGAPKWQGPEEQDSRWFEPVKWKNFSHVSTAPIECPETFVGDQSGVYIVTGAQLGVWDFGSRNVLYMKLLFSRLPGCTIRRSLWDHKPNEESKKSAATGNNSGDSSSASGETLAGNKIAKSVDMSAMSKGPQDAPGHWLVTGGKLGVEKGKIVLRVKYSLLNY

SEQ ID NO: 741 - protein, 386 aa, Celosia argentea (Sylphid)
MEMKSYVQEIGNQRFMPKESHTSSGPIRVKEKVGDSGLFNSQGIYPQPTSVPSVNGKEDITVIFRRRGGDDLEHSHRQWAMTVKSSPDIIEMTFVPITDLIKDSARKEYLSRAINLYLEYKPAIEELRYFLEFQIPRVWAPVHNRLLRHQRKEPVCPSLQFSLMGQKLYISQEQVSVGRKPVTGLRLFLEGAKQNRLCIHLQHLASLPKILVPCWDTHVAIGAPKWMGPEEQDSRWFEPVKWKNFSHVSTAPIESHESFAGEVSGVHIVTGAQLGVWDFGSRNVLYMKLLYSRLPGCTIRRSLWDHTPIEKPWKAGGSAESTSGDSSSGGSSESVSAGNKLVKFLDMSEMTKGPEDLPGHWLVTGGKLGIEKGKIVLRVKYSLLNY

SEQ ID NO: 742 - protein, 347 aa, Verbascum chaixii (Vill)
MEENAAALHTAINSVQALGRGFDVNYDTRLLYCKGVAGSRIVDIDEEHPRDLYLSDNLVVPNVSRDIKSSVEAGGRDGFGVCSYSEMVEYFNRKADLSGQTPLGSFNVAFSYTGSKHIDAASTKSLCMDGFFIPLAKIQLVKASMSLNENVRRAVPTSWDPPGLASFIENFGTHVITSVTIGGKDVIYVKQHLSSPLAMVEIKNYVQDIGNQRFSSPEGLTNSGLLRYKDKGSDPSLFNSQGIYPQPASAPYLSWSGKEDVTVIFRRRGGDDLEQSHIQWAKTVRSSPDVIEMSFFPITELLDGVRGKEHLARAISLYLEYKPQIEELRYFLEFPDSCLTLNCSCTT

SEQ ID NO: 743 - protein, 300 aa, Tupidanthus calyptratus
MEPRKNMSSDALNTTLWNSIQALGRGFDVTSDIRLLYCKGIPGSRLVQINDGVTKDLAVSDGFVVPNVSVDIESSRGEEVTETTAVCSFHEMAIYFNEKSEISGDVPLGSFNAMFNLTGSWQLDAATTKSLAMIGSVIPLYKVELANLDLVLNEEVKRAVPYSWDPASLASFIENYGTHIVTSATVGGRDVVYIRQHQSSPLSVSDIENYVKDIADQRYSESRSHPSAAPLKYKDKDVTVIFRRRGGDDLEQSHIRWAETVQTSPDVINMTFIPIVSLLEGVPGIKHLACAIELYLECKI

SEQ ID NO: 744 - protein, 410 aa, Tupidanthus calyptratus
MEENAAALHTAMNSVQALGRGFDVNFDIRLLYCKGVAGSRIVEIDEEHTRDMCLYDGLVVPNVSKDVHNSQETIGRDGSGVCNYFEMVEYINKKANLSENVPVGCFNAAFNFTGCKHIDAAATKTLCLDGFFIPLSKVQLIKSQLVLQENVIDGFFIPLAKVQLVKSQLVLQENVIRAVPASWDPPALASFIENFGTHVIVSVTIGGKDVIYVKQHQSSPLSKVEIKKYVQDIGNQRFSTTENHTISGLLKYKDKGVDPSLYNSQGVHPQPSTATSLIGNGKEDVTVIFRRRGGDDLEQSHTQWARTVRSSPDVIEMSFFPIIPLLEGVTGKEHLAQAIDLYLEYKPQIEELRYFLEFQVPRIWAPIQDRPPGYQRKEPVCPSLQFSMMGQKLYISQEQVSVGRKPVTGS

SEQ ID NO: 745 - protein, 560 aa, Tupidanthus calyptratus
MEPRKNMSSDALNTTLWNSIQALGRGFDVTSDIRLLYCKGIPGSRLVQINDGVTKDLAVSDGFVVPNVSVDIESSRGEEVTETTAVCSFHEMAIYFNEKSEISGHVPLGSFNAMFNLTGSWQLDAATTKSLAMIGSVIPLYKVELANLDLVLNEEVKRAVPYSWDPASLASFIENYGTHIVTSATVGGRDVVYIRQHQSSPLSVSDIENYVKDIADQRYSGSRSNPSAAPLKYKDKDVTVIFRRRGGDDLEQSHVRWAETVQTSPDVINMTFIPIVSLLEGVPGIKHLACAIELYLEYKPPIEDLQYFLEFQIARVWAPEQSNIQRKDPVCPSLHFSLMGPKLYISPDQVTVGRKPVTGLRLTLEGTKQNRLAIHLQHLVSLPKILQPHWDAHMAIGAPKWQGPEEQDSRWFEPIKWKNFSHVSTAPIEHTETCIGDLSGVYIVTGAQFGVWDFGASKSVLHLKLLFSKVPGCTIRRTVWDHSPSNVSGVQRSNGASTSLLHERTTDSSGHIGKLAKIVDMTEMSKGPQDIPGHWLVTGAKLGVDKGKIVLRIKYSLLNY

SEQ ID NO: 746 - protein, 276 aa, Pellaea rotundifolia
MADEDASLRGAHATALNAIQAVGRGFDVTCDIRLLYCKGTPGSRLVVVDDEHTTDLKLLDGLDIPKVSTDIRARQEKPSRASLGVQDFDQMSELFNKKLNIRGKIPSGLFNSMFSFSGSWQVDASMTKSLALDGVLLPLYSVHLRSPFILCEEVKKAVPSTWDPAALASFIEKYGTHVILSVEVGGKDIVYVKQHQSSSLTKSEVELQLRKLVETRFQGMEMGIADVNNKLQELPPLSSQKNHSKIVHADGSSSLTGKEDITVIYRRRTSCKSCHH

SEQ ID NO: 747 - protein, 545 aa, Matteuccia struthiopteris
MADEDASSRGARVTAVNAVQALGRGFDVTCDIRHLYCKGTPGSRLVVIDDDHTADLKVSDSLVIPNVSADIKARMEKPSRPSLGVQDFDQMSELFNKKFCIGGKIPSGMFNAMFNFSGSWQVDSSMTKSLAVDGVVIPLYSVHLRAPFILCEEVKKAVPSTWDPAALASFIEKYGTHVIISVEVGGKDVIYVKQPQSSSLTKSEVDSHLKKLVETRFQGMESGVTQAKDKFQELALNQQKNRSQLVHADGSSSLTGKEDITVIYRRRGGDDLVQDHLEWKKTVYSNPDILSMAFFPIVLLLDGGSGREHLNRAIEAHLKYKPPLEELQYFLEFQVTRAWAPVANQVGLPRKEPVCPTLQFSLMGPKLFISTDQVSVGRKPVTGLRLCLEGSKLNRLAVHVQHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHTPTGQQQSKAKMGTSSASPDCCCCCCCCCYTNDSETLQVC

SEQ ID NO: 748 - protein, 300 aa, Tupidanthus calyptratus
MEPRKNMSSDALNTTLWNSIQALGRGFDVTSDIRLLYCKGIPGSRLVQINDGVTKDLAVSDGFVVPNVSVDIESSRGEEVTETTAVCSFHEMAIYFNEKSEISGHVPLGSFNAMFNLTGSWQLDAATTKSLAMIGSVIPLYKVELANLDLVLNEEVKRAVPYSWDPASLASFIENYGTHIVTSATVGGRDVVYIRQHQSSPLSVSDIENYVKDIADQRYSGSRSNPSAAPLKYKDKDVTVIFRRRGGDDLEQSHVRWAETVQTSPDVINMTFIPIVSLLEGVPGIKHLACAIELYLECKI

SEQ ID NO: 749 - protein, 302 aa, Verbascum chaixii (Vill)
MASMGSENALITTLCNSIQALGRGFDVTSDIRLLYCKGAPGSRLVHINEEQTRNLEISGSYAIPNVSVDIECSQGQSFNNKTPVWSFHEMAKYFNEKSGLPGNIPLGCFNAMFNFSGSRQLDAAATKSLAMVGYIIPLFTVKLAKPDLILHDQIKRAVPYSWDPASLASFIENYGTHIVTSATIGGRDVVYIRQHQSSPLSTSDIENYVKDIGDQRFSDSKGNSSAGSLKYKDKDVTVIFRRRGGDDLEQSYEKWAKSVEGAPDVISMTFTPIVSLLEGVPGIKHLARAIELYLECKNLILC

SEQ ID NO: 750 - protein, 561 aa, Doellingeria umbellata
MNDTKMEDLSISKNDNNNNNNALITTLKNSIQALGRGFDVTSDIRLLYCKGPPGSCLVHLDSQHTRHLVFSDDGFLSIPNVSVDVDFSKGQPTIEATPVSTFHQMAKYFNMKSNLSGDVPLGSFNAMFNFTGSRQVDAASTKSLAMIGYIVPLFEVRLEISDLVLLQEVKQAVPYSWDPASLASFIENYGTHIVTSATVGGRDVVYIKQHQSSPLSILDIDNYVKDIGDHRFVDSKSQSSSGPLKYKDKDVTVIFRRRGGDDLEQSHAKWVETVETAPDVINMTFTPIVSLLDGVPGIKHLSKAIELYLEYKPPIEDLQYFLEFQISRVWAPEQSNIQRKEPVCPSLQFSLMGPKLYISLEQVTVGRKPVTGLKLNLEGSKQNRLAIHLQHLVSLPKILQPHWDAHMAIGAPKWQGPEEQDSRWFEPIKWKNFSHVSTAPIEHTETYIGDLSGVHIVTGAQFGVWDFGARSVLHLKLLFSKVPGCTIRRSVWDHSPANLQKHGEDKGDSSSQSGKLAKIVDMTEMSKGPQDVPGHWLVTGAKLGVDKGRIVLRIKYSLLNY

SEQ ID NO: 751 - protein, 428 aa, Sphaeropteris cooperi
MAEDDTSFRGARATALNALQALGRGFDVTCDIRLLYCKGAPAGARLVKIDEENCWDLALSDGLRIPNVSVGIKARQEECKRLSLGVSDFDQMSELFNRKLGIMGKTPLGMFNAMFSFSGSSQIDASMTKSLAVDGWVIPLYSVHLRAPFMLCEEVRKAVPTTWDPSALASFIEKYGTHIIIGVEVGGKDVIYVKQHQSSILTKSEIELHLKRLVETRFQGVENSVFKAEDKLQELAMFTTQKIRSQPLHADGSSSLTGKEDITVIYRRRGGDDLVQDHIEWKKTVYTNPDVLSMSFSSIVLLLEPGSGRDNLNRAIEAYLTYKPPLEELHYFLEFQVPRAWAPVVNQVGPPRKEPVCPPLQFSLMGPKLFISTDQISVGRKPVTGLRLCLEGSKLNRLAIHLQHLTVLPKILQPHWDSYVAIGAPKWV

SEQ ID NO: 752 - protein, 469 aa, Asplenium antiquum (makino)
MFNAMFNFSGSWQVDSSLTKRLAVDGLVLPLYSVHLRSPFILCEEVKKAVPNIWDPVALASFIEKYGTHIIRSVEVGGKDTIYVKQHPSSTLTKEEVESHLTKLVESRFQGRESDVIRRKDKENTDSSSSLTGKEDITVIYRRRGGDDLVQDHVDWKKTVNFNPDILSMAFFPIVLLLDAGSGREHLNRAIEAHLKYKPPLEELHYFLEFHVARAWAPLANPVGPPRKEPICPALQFSLMGPKLFINTSQVSVGRKPVTGLRLCLEGSKLNRLAVHVQHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHTPTGQQQSKGTKGTSSASPAAGTAAAPAAAAAAAATPATQKLSKFVDMSEMARGPQDLPGHWLVTGAKLCVEKSNIFLRVKYSLLNY

SEQ ID NO: 753 - protein, 581 aa, Equisetum
MAEDEPSCTLATSVIQALGQGFDITSDIRLSYCKGSRLVQIDTEQTSDLVLPGVTASIPQVPTEIKCLPGRIMRHGTGVLDFEKMAQRFNKALSVNGKIPSGLFNAMFSFSGSWRADAHVTKSLALDGWFIMLYNLKLAQSSFKLRGEIKREVPSTWDPAALASFIERHGTHIVTSVTVGGKDAIYVKQHQSSSLTSMEIESYLKELGDRRFLARSKHSAFEMKEKGAGQSFPPPAQSLLPTSASDSSSSLTGKEDVTVIYRRRGGDDLVQNHEEWKYTIFSNPDVISMTFIPIASLLEGCPGKEHLIRAIDIYLEYKPPIEELQYFLEFQVAKVWAPVQNEGRLPRKEPVCPSLQFSLMGPKLYINTEQVSVGRRPVIGLRLCLEGSKVNRLSVHVLHLVALPKLLQPHWDSYVAIGPPKWHGPEEQDSRWFEPIQWKNFSHVSTAPIEYSEGWMGDDSGAHVVTGAQLGVWDFGPKSVLHLRLLYSKVPGCTIRRSIWDYNPNPSSFNPSINPSKASKEANASSSSNAPQVNKLAKFVDTEEMVKGPQDMPGHWLVTGAKLGVEKSKIFLRVKYSLLNY

SEQ ID NO: 754 - protein, 265 aa, Asplenium prolongatum x Asplenium antiquum (Kurata)
MAEGDSSSRGAFVTGVNAVQALGRGFDATCDIRLLYCKGTPGTRLVVIDDDHTTDLKVSDGVVIPNVSTDIRARLEKPYRPSLGVQGFHEMSEEFNKKLSIGGNIPSGMFNAMFNFSGSWQVDSSMTKRLAVDGLVLPLYSVHLRSPFILCEEVKKAVPNIWDPAALASFIEKYGTHIIRSVDVGGKDIIYVKQHPSSTLTKHEVESHLKKLVESRFQAMESDVNQRKDKENSESSSSLTGKEDITVIYRRRGGDDLVQDHVEWK

SEQ ID NO: 755 - protein, 587 aa, Symphoricarpos x chenaultii (Hancock)
MEENAAALHTAINSVGALGRGFDVNFDTRLLYCKGVAGSRVVEIDEEHSWDLRLYDSLVVPNVPREIKNSHETSGRDGFGVCSYHEMAEYFNKKANLSGHVPLGSFNAAFSFTGSKHIDAAATKTLCMDGYFIPLAKVQLNKSPLVLQENVRRAVPTSWDPPALASFIENFGTHIITSVTIGGKDVVYIKQHQSSPLSTTEIKNYVKDIGNQRFSSTESHTSSGQLNYKDKASSGADPSLFNSQGIYPQPTTAPSLTGNGKEDVTVIFRRRGGDDLVQSHTQWEKTVQYSPDVIEMSFSPITLLLEGIIGKDHLTRAINLYLEHKPQIEELRYFLEFQVPRIWAPAQDRLPGHQRKEPVCPSLQFSIMGQKLYVSQEQISVGRKPVTGMRLNLEGSKQNRLSIHLQHLASLPKILQPYWDSNVAIGAPKWQGPEEQDSRWFEPVKWKNFSHVSTAPIESPETFIGNLSGSFIVTGAQLGVWDFGSRNVLYMKLLYSRLPGCTIRRSLWDHAPNDKSKRRVPVDSSNGGSSSGSGESMVGNKLAKYVDMKEMSKGPQDPPGHWLVTGGKLGVEKGKIVLRLKYSLLNY

SEQ ID NO: 756 - protein, 585 aa, Polystichum polyblepharum (LW12418)
MADEDASFRGAHGTAVNAVQALGRGFDVTCDIRLLYCKSTPGSRLVVINDDHTANLNVSDGLVIPNVSKDIKARLEKPFRPSEGAQDFDQMSELFNKKLGIGGKIPSGTFNAMFNFSGSWQVDSSITKSLSVDGVVIPLYSVHLRPPFILREEVKMAVPSTWDPPALASFIEKYGTHIIISVEVGGKDTIYVKQHLSSSLTKSEVDSHVKKLVETRFQGMESGVTQAKDKFQELALTNPQKNRSQLVHDDGSSSLTSKEDITVIYRRRGGDDLVQDHLEWKKTVNTNPDILSMAFFPIVVLLDAGSGREHLNRAIEAHLQYKPPLEELQYFLEFQVTRAWAPVANQVGLPRKEPVCPSLQFSLMGPKLFISTDQVSVGRKPVTGLRLCLEGSKLNRLAVHLQHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHTPIGQQLSKAKKGTSSATAAAAAAATVTQTTQKLSKFVDTTEMARGPQDLPGHWLVTGAKLCVEKSNIFLRVKYSLLNY

SEQ ID NO: 757 - protein, 581 aa, Asplenium antiquum (Crissie)
MADEDASSRGALVTAVNAVQALGRGFDVTCDIRLLYCKGTPGSRLVVVDDDHNTYLRVSDGVVIPNVSADIRARLEKPSRPTLGVQGFDEMSEEFNKKLFIGGNIPSGMFNAMFNFSGSWQVDCSMTKRLAFDGLVLPLYSVHLRSPFILCEEVKKAVPNIWDPAALASFIEKYGTHIIRSVEVGGKDITYVKQHSSSTLTKEDVESHLKKLVESRFQGSKSDEIRRKDKETTDSSSSLTGKEDITVIYRRRGGDDLVQDHVEWKKTVNSNPDILSMAFFPIVLLLDPGTGREHLNRAIEAHLKYKPPLEELHYFLEFHVTRAWAPLANPVGPPRKEPICPALQFSLMGPKLFINTSQVSVGRKPVTGLRLCLEGSKLNRLAVLVQHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHTPIGQQQSKAKGASSASPATGSAAPDAVGASVAAAAAAATQATQKLSKFVDTSEMARGPQDLPGHWLVTGAKLCVGKSKIFLRVKYSLLNY

SEQ ID NO: 758 - protein, 347 aa, Verbascum chaixii (Vill)
MEENAAALHTAINSVQALGRGFDVNYDTRLLYCKGVAGSRIVDIDEEHPRDLYLSDNLVVPNVSRDIKSSVEAGGRDGFGVCSYSEMVEYFNRKADLSGQTPLGSFNVAFSYTGSKHIDAASTKSLCMDGFFIPLAKIQLVKASMSLNENVRRAVPTSWDPPGLASFIENFGTHVITSVTIGGKDVIYVKQHLSSPLAMVEIKNYVQDIGNQRFSSPEGLTNSGLLRYKDKGSDPSLFNSQGIYPQPASAPYLSWSGKEDVTVIFRRRGGDDLEQSHIQWAKTVRSSPDVIEMSFFPITELLDGVRGKEHLARAISLYLEYKPQIEELRYFLEFQVPCLTLNCSCTT

SEQ ID NO: 759 - protein, 400 aa, Platycerium wandae
MANEDVSRGARATAINAVQAIGRGFDITCDIRLLYCKGTPGSRLVVIDDDHTADLQVADDLVIQNVSKDIKARIEKPSRAYQGILDFDQMSELFNKKLSIDGKVPSGMFNAMFNFSGSWQVDSSSTKSLATDGMHIPLYSVHLRPPFILCEEVKRAVPSTWDPPALASFIEKYGTHIIRSVEAGGKDIIYMKQHSSSILSKTEVETHLKKLVEARFQDLDLQSNDEELKLSNPQKHRSQLVHADGSSSLTGKEDITVIYRRRGGDDLVQDPREWKKTVKSNPDILTMSFFPIVLLLDPGPGREHLNRAMDAHLKYKPPLEELQYFLEFQVTRAWAPVANQVGLPRKEPVCPSLQFSLMGPKLYISTDQVSVGRKPGASSLSGRKQAKSACRLRRAPHRAS

SEQ ID NO: 760 - protein, 397 aa, Asplenium prolongatum x Asplenium antiquum (Kurata)
MADEDASLRGAFATAVNAVQALGRGFDVTCDIRLLYCKGTPGTRLVVIDDDHTTDLKVSDGVVIPNVSTDIRARLEKPYRPSLGVQGFHEMSEEFNKKLSIGGNIPSGMFNAMFNFSGSWQVDSSMTKRLAVDGLVLPLYSVHLRSPFILCEEVKKAVPNIWDPAALASFIEKYGTHIIRSVDVGGKDIIYVKQHPSSTLTKHEVESHLKKLVESRFQAMESDVNQRKDKENSESSSSLTGKEDITVIYRRRGGDDLVQDHVEWKKTVNFNPDILSMAFFPIVLLLDPGTGREHLNRAIEAHLKYKPPLEELHYFLEFHVTRAWAPLANPVGPPRKEPICPGLQFSLMGPKLFINTSQVSVGRKPVTGLRLCLEGSKLNRLAVHVQHLTVLPKILQP

SEQ ID NO: 761 - protein, 576 aa, Stenochiaena tenuifolia
MADKDASSRGARGTAVNAVQALGRGFDVTCDIRLLYCKGAPGSRLVIIDDDHTADLKLSDSLVIPKVSKDIKARLDKPYCPSPGAQDFDQMSELFNRKLGIGGRIPSGMFNAMFNFSGSWQVDASMTKSLAVDGVFIHLYSVHLKAPFILCEEVKKAVPSTWDPAALASFIEKYGTHVIIGVEVGGKDIIYVKQHQSSSLTKTEVDLHLKKLVEMRFQEKESKEPALPPQKNRSQFVHADGPSSLTGKEDITVIYRRRGGDDLIQDHLEWKKSVHSNPDILSMTFFPIVLLLDAGSGREHLNRAIEAYLRYKPPLEELHFFLEFQVPRAWAPVASQVVLPRKEPVCPTLQFSLMGPKLFINTDQVSVGRRPVTGLCLCLEGSKFNRLAVHVQHLTVLPKILQPHWDAYVAIGAPKWHGPEEQDSRWFEPVLWKNFAHVSTAPVEFSETWFGDASGAYIVTGAQLGVWDFGVKSVLHLKLLYSKVPGCTIRRSVWDHTPTGLQQSKAKTGMSSTSATSAAATTTAMQTTQKLSKFVDTTEMARGPEDLPGHWVVTGAKLCVEKSNIFLRVKYSLLNY

SEQ ID NO: 762 - protein, 585 aa, Davallia fejeensis
MASEDASLPGARATALNAVQALGRGFDVTCDIRLLYCKGTPGSRLVVVDDHTTDLKVANGLVIHNVSKDIKARLEKPSRAYQGVQDFDQMSELFNKKLFIEGKIPSGMFNAMFNFSGSWQVESLAIDGMHIPLYSVHLRSPFILCDEVKRAVPSTWDPPALASFIEKYGTHIIRSVEVGGKDIIYVKQHPSSNLTKSEVETHLKKLVETRFQGMESGLVHQKDEYQELTLMNQQKNRSQLVHADGSSSLTGKEDITVIYRRRGGDDLVQDPLEWKKTVNSNPDILTMAFFPIVLLLDPGPGREHLHRAIEAHLKYKPPLEELQYFLEFQVTRAWAPLSNQVGLPRKEPVCPSLQFSLMGPKLFISTDQVSVGRKPVTGLRLCLEGSKLNRLAVHVEHLTVLPKILQPHWDAYVAIGAPKWHGPEEQDSRWFEPVLWKNFAHVSTAPVEFSETWFGDASGAYIVTGAQLGVWDFGVKSVLHLKLLYSKVPRCTIRRSVWDHTPIGQQLSKAKKGASSTAAAAVAAAASIGAAATSQAMQKLSKFVDTTEMSRGPQDLPGHWLVTGAKLCVEKSNIFLRVKYSLLNY

SEQ ID NO: 763 - protein, 354 aa, Verbascum chaixii (Vill)
MALPSENALITTLGNSIQALGRGFDVTSDIRLLYCKGAPGSRLVHINEEQTRNLEISGSYAIPNVSVDIECSQGQSFNNKTPVWSFHEMAKYFNEKSGLPGNIPLGCFNAMFNFSGSRQLDAAATKSLAMVGYIIPLFTVKLAKPDLILHDQIKRAVPYSWDPASLASFIENYGTHIVTSATIGGRDVVYIRQHQSSPLSTSDIENYVKDIGDQRFSDSKGNSSAGSLKYKDKDVTVIFRRRGGDDLEQSYEKWAKSVEGAPDVISMTFTPIVSLLEGVPGIKHLARAIELYLEYKPPIEDLQYFLDFQISRAWAPEQNNNLQRKEPVCSSLQFSLMGAKLYISPDQVYINIIP

SEQ ID NO: 764 - protein, 351 aa, Platycerium bifurcatum
MANEDVSRGARATAINAVQAIGRGFDITCDIRLLYCKGTPGSRLVVIDDDHTADLQVADDLVIQNVSKDIKARIEKPSRAYQGILDFDQMSELFNKKLSIDGKVPSGMFNAMFNFSGSWQVDSSSTKSLATDGMHIPLYSVHLRPPFILCEEVKRAVPSTWDPPALASFIEKYGTHIIRSVEAGGKDIIYMKQHSSSILSKTEVETHLKKLVEARFQDLDLQSNDEELKLSNPQKHRSQLVHADGSSSLTGKEDITVIYRRRGGDDLVQDPREWKKTVKSNPDILTMSFFPIVLLSNCPKDGSSSLTGKEDITVIYRRRGGDDLVQDPREWKKTVKSNPDILTMSFFPIVL

SEQ ID NO: 765 - protein, 582 aa, Ophioglossum pendulum
MEEDDNDSALKASIVVNALQTLGRGFDLTCDIRIIYCKGTERSRLIEIDEEHTKTLEVPGGISIPNVSRDIKCVQGTEEHFSTGVLDFEQMAGYFNEVLSLSGKTASGVFNAVFNFSGSWNSDALATKSLAVDGWSIILYSLSLTRAPLTLIHEVKAAVPYTWDPAALASFIEKYGTHIVTSVSVGGKDAIYVKQHQSSTLTSTDVELHLKELRSIRFSPYGGHISFLGNEKVADQMLFSTQQILPQPCNSNGSSSFAGKEDITVIYRRRGGNDLVQGHDEWKKTVPTNPDVVTMTFVPITSLLENGPRSDHLSRAILVYLEYKPPIEELQYFLAFQVARVWAPVQNELGPPRREPVCPALQFSLMGPKLYISTEQVSVGRRPVTGLRLSLEGRNCNRLAVHVQHLTSLPKVLQPHWDAYIAIGAPKWHGPEEQDSRWFEPVLWRSFSHISTAPVEFSETWVGDASGAFIVTGAQLGVWDFGLKSVLYLRLLYSKVPGCTIRRSVWDHTPVPLSQHLKVKTSSKTSVSTATSETPKLLKFVDTTEMSRGPQDMPGHWMVTGAKLGVEKSKIFLRVKYSLLNY

SEQ ID NO: 766 - protein, 324 aa, Asplenium prolongatum x Asplenium antiquum (Kurata)
MADEDASLRGAFATAVNAVQALGRGFDVTCDIRLLYCKGTPGTRLVVIDDDHTTDLKLSDGLVIPNVSTDIRARLEKPSRPSLGVRGFDEMSEEFNKKLSIGGNIPSGMFNAMFNFSGSWQVDSSMTKRLAVDGLVLPLYSVHLRSPFILCEEVKKAVPNIWDPAALASFIEKYGTHIIRSVDVGGKDIIYVKQHPSSTLTKHEVESHLKKLVESRFQAMESDVNQRKDKENSESSSSLTGKEDITVIYRRRGGDDLVQDHVEWKKTVNFNPDILSMAFFPIVLLLDPGTGREHLNRAIEAHLKYKPPLEELHYFLEFHVTRAW

SEQ ID NO: 767 - protein, 550 aa, Symphoricarpos x chenaultii (Hancock)
MDDALTTTLFNSIQALGRGFDVTSDIRLLYCKGAPGSRLIHLDDQHVKDLVLNDGFVVPNVSVDVECSTGNRNPETISVCSFHEMAKYFNEKSDISGHVPLGSFNSMFNFTGSRQIDAAATKSLAMIGYVIPLYKVKLSISNLVLHEDVNRAVPYSWDPASLASFIENYGTHIVTSATVGGRDIVYIRQHQSSPLSAPDIDNYVKDIGDQRFSEVKGHQSAGPLKYKDKDVTVIFRRRGGDDLEQSHSKWSETVRRAPDVINMTFTPIASLLEGVPGIKHLARAIDLYLEYKPPIEDLQYFLEFQIARAWAPEQSNLQRKGPVCSSLQFSLMGPKLYISPDQVTVGRKPVTGLRLTLEGIKQNRLAINLQHLVSLPKILQPHWDAHMAIGAPKWQGPEEQDSRWFEPIKWKNFSHVSTAPIEHTETCIGDLSGVHIVTGAQFGVWDFGAKSVLHLKLLFSKVPGCTIRRSVWDHSPSNISTSQRPNGASTSDEKKVDGSSQAGKLAKIVDMTEMSKGPQDVPGHWLVTGAKLGVDKGKIVLRVKYSLLNY

SEQ ID NO: 768 - protein, 585 aa, Polystichum tripteron
MADEDASFRGARGTAVNAVQALGRGFDVTCDIRLLYCKSTPGSRLVVIDDDHTANLNVSDGLVIPNVSTDIRARLEKPFRPSPGVQDFDQMSELFNKKLGIGGKIPSGMFNAMFNFSGSWQADSSITKSLSVDGVIIPLYSVHLRSPFILREEVKMAVPSTWDPPALASFIEKYGTHIIISVEVGGKDAIYVKQHLSSSLTKSEVDSHLKKLVETRFQGMESGVTQAKDKFQDLALTNPQKNRSQLVHADGSSSLTGKEDITVIYRRRGGDDLVQDHLEWKKTVNTNPDILSMAFFPIVLLLDAGSGREHLNRAIEAHLQYKPPLEELHYFLEFQVPRAWAPVANQVGLPRKEPVCPLLQFSLMGPKLFISTDQVSVGRKPVTGLRLCLEGTKLNRLAVHLQHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHTPIGQQLSKAKKGTSSATAAAAAAATVTQTTQKLSKFVDTTEMARGPQDLPGHWLVTGAKLCVEKSNIFLRVKYSLLNY

SEQ ID NO: 769 - protein, 424 aa, Tupidanthus calyptratus
MEENAAALHTAMNSVQALGRGFDVNFDIRLLYCKGVAGSRIVEIDEEHTRDMCLYDGLVVPNVSKDVHNSQETIGRDGSGVCNYFEMVEYINKKANLSENVPVGCFNAAFNFTGCKHIDAAATKTLCLDGFFIPLAKVQLVKSQLVLQENVIRAVPASWDPPALASFIENFGTHVIVSVTIGGKDVIYVKQHQSSSLSKVEIKNYAQDIGNQRFSTTENHTYVKQHQSSPLSKVEIKNYAQDIGNQRFSTTENHTISGLLKYKDKGVDPSLYNSQGVHPQPSTATSLIGNGKEDVTVIFRRRGGDDLEQSHTQWARTVRSSPDVIEMSFFPIIPLLEGVTGKEHLAQAIDLYLEYKPQIEELRYFLEFQVPRIWAPIQDRPPGYQRKEPVCPIFAVQHDGAKALHQPRASFSWAQTRDRYAFMS

SEQ ID NO: 770 - protein, 354 aa, Blechnum gibbum
MAEENASSRGARVTAVNAVQALGRGFDVTCDIRLLYCKGTPGSRLVVIDDDHTADLKLSDSLVIPNVSTDIKARLDKPSFPSPGVQDFDQMSELFNKKLAIGGKIPSGMFNAMFNFSGSWQVDSSMTKSLAFDGVVIPLYSVHLRAPFILCEEVKKAVPTTWDPAALASFIEKYGTHVIISVDVGGKDIIYVKQHQSSPLTKSEVDLHLKKLVETRFQGMESGVIQAKDKFQELALNPQKNRSQLVHADGSSSLTGKEDITVIYRRRGGDDLVQDHLEWKKTVHSNPDILSMAFFPIVLLLDAGSGREHLIRAIEAHLKYKPPLEELHYFLEFQVPRAWAPAFYCWMLAQVESI

SEQ ID NO: 771 - protein, 608 aa, Tupidanthus calyptratus
MGENAAALHTAMNSVQVGDLMSILTSGCCIAREWQGQGLWKLMKSIPGICACMTVLLCPMFQKMCTTLRRRLAVMVLAFAIILRWWSTLICNYFEMVEYINKKANLSENVPVGCFNAAFNFTGCKHIDAAATKTLCLDGFFIPLAKVQLVKSQLVLQENVIRAVPASWDPPALASFIENFGTHVIVSVTIGGKDVIYVKQHQSSSLSKVEIKNYAQDIGNQRFSTTENHTTSGLLKYKDKGVDHTTSGLLKYKDKGVDPSLYNSQGVHPQPSTATSLIGNGKEDVTVIFRRRGGDDLEQSHTQWARTVRSSPDVIEMSFFPIIPLLEGVTGKEHLAQAIDLYLEYKPQIEELRYFLEFQVPRIWAPIQDRPPGYQRKEPVCPSLQFSMMGQKLYISQEQVSVGRKPVTGMRLCLEGSKQNRLIIHLQHLACLPKILQPYWDTHVSIGAPKWQGPEEQDSRWFEPVKWKNFSHVSTAPIECPETFVGDQSGVYIVTGAQLGVWDFGSRNVLYMKLLFSRLPGCTIRRSLWDHKPNEESKKSAATGNNSGDSSSASGETLAGNKIAKSVDMSAMSKGPQDAPGHWLVTGGKLGVEKGKIVLRVKYSLLNY

SEQ ID NO: 772 - protein, 581 aa, Marsilea mutica
MAENDKFKLARTTAVNAVQALGRGFDVTCDIRLLYCKGSPGSRLLKVDEETLEDLVLADDVRVPRVSSDIKKKPEIPSRYSLGVLDFDQMSELFNKKLGISGKTPLGMFNAMFSFSGCVQADKSQTKSLAVDGWNIPLYSVYLKPPFILSEEVKKAVPSTWEPAALASFIEKYGTHIILSVEVGGKDVIYVKQHESSNLTKAEMELHLNKLFESRFKGIESSMFTSENKHKEQLMFTNPKVRSQPFSTDVTSSLTGKEDITVIYRRRGGNDLVQDHMQWKDTVNESPDVLSMTLLPTSSLLDPGPGYENLSRAIDAYLNFKPPLEELQYFLEFQVPRAWAPVVNPVGPRKEPVCPALQFSLMGPKILICTDQVSVGRKPVTGLRLCLEGAKVNRLAVHVQHLTTLPKILQPHWDSYIPIGAPKWHGPEEQDSRWFEPVLWKNFSHVSTAPIEYNETWFGDASGAFIVTGAQLGVWDFGLKSVLHLKLLYSKVPGCTIRRSVWDHTPGPSEQQQSKAKKVVSNSNPITVATQATQKLMKFVDTSEVMRGPEHLPGHWLVTGAKLCVEKSKIFLRVKYSLLNY

SEQ ID NO: 773 - protein, 587 aa, Platycerium wandae
MANEDVSRGARATAINAVQALGRGFDVTCDIRILYCKGTLGSRLLIIDDDHTADFQVADDLVIPNVSKDIKARIEKPSRAYQGVLDFDQMSELFNKKLSIEGKVPSGMFNAMFNFSGSRQVDSSSTKSLAIDGVHIPLFSVHLRPPFILCEEVKRAVPSTWDPPALASFIEKYGTHIIRSVEVGGKDIIYMKQHSSSNLSKTEVETHLKKLVEARFQDLDLQSNDEELKFLNPQKNRSQLVYADGSSSLTGKEDITVIYRRRGGDDLVQDPWEWKKTVKSNPDILTMSFLPIVLLLDPGPGRDHLNRAIDAHLKYKPPLEELQYFLEFQVTRAWAPVANQVVLPRKEPVCPSLQFSLMGPKLYINTDQVSVGRKPVTGLRLCLEGSKLNRLAVHVEHLTVLPKILQPHWDAYVAIGAPKWHGPEEQDSRWFEPVLWKNFAHVSTAPVEFSETWFGDASGAYIVTGAQLGVWDFGVKSVLHLKLLYSKVPGCTIRRSVWDHTPIGQQASKAKKGASSAAAAGVAAAAAAVGAAASSTQTMQKLSKLIDMTEMSRGPQDLPGHWLVTGAKLCVEKGNIFLRVKYSLLNY

SEQ ID NO: 774 - protein, 456 aa, Asplenium antiquum (Crissie)
MTKRLAFDGLVLPLYSVHLRSPFILCEEVKKAVPNIWDPAALASFIEKYGTHIIRSVEVGGKDITYVKQHSSSTLTKEDVESHLKKLVESRFQGSKSDEIRRKDKETTDSSSSLTGKEDITVIYRRRGGDDLVQDHVEWKKTVNSNPDILSMAFFPIVLLLDPGTGREHLNRAIEAHLKYKPPLEELHYFLEFHVTRAWAPLANPVGPPRKEPICPALQFSLMGPKLFINTSQVSVGRKPVTGLRLCLEGSKLNRLAVLVQHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHTPIGQQQSKAKGASSASPATGSAAPDAVGASVAAAAAAATQATQKLSKFVDTSEMARGPQDLPGHWLVTGAKLCVGKSKIFLRVKYSLLNY

SEQ ID NO: 775 - protein, 382 aa, Verbascum chaixii (Vill)
MEENAAALHTAINSVQALGRGFDVNYDTRLLYCKGVAGSRIVDIDEEHPRDLYLSDNLVVPNVSRDIKSSVEAGGRDGFGVCSYSEMVEYFNRKADLSGQTPLGSFNVAFSYTGSKHIDAASTKSLCMDGFFIPLAKIQLVKSSMALKENVRRAVPTSWDPPGLASFIENFGTHVITSVTIGGKDVIYAKQHHSSPLSMVEIKNYVQDIGNQRFSSVEVVTNSGVLKYKDKGSDPSLFNSQGIYPQPASAPYLSWSGKEDVTVIFRRRGGDDLEQSHIQWAKTVRSSPDVIEMSFFPITELLDGVRGKEHLARAISLYLEYKPQIEELRYFLEFQVPRIWAPVSDRFPGQPRKEPVCPSLRVTIQHDGTKAICQPRASFSWA

SEQ ID NO: 776 - protein, 589 aa, Pellaea rotundifolia
MADEDASLRGAHATALNAIQAVGRGFDVTCDIRLLYCKGTPGSRLVVVDDEHTTDLKLLDGLDIPKVSTDIRARQEKPSRASLGVQDFDQMSELFNKKLNIRGKIPSGLFNSMFSFSGSWQVDASMTKSLALDGVLLPLYSVHLRSPFILCEEVKKAVPSTWDPAALASFIEKYGTHVILSVEVGGKDIVYVKQHQSSSLTKSEVELQLRKLVETRFQGMEMGIADVNNKLQELPPLSSQKNHSKIVHADGSSSLTGKEDITVIYRRRGGDDLIQDHLEWKKTVYTNPDVLSMSLFPIVFLLDPGPGRENLNRAIEAYTIYKPPLEELQYFLEFQVSRAWAPVANQLGLPRKEPVCPSLQFSLMGPKLFISTDQISVGRKPVTGLRLCLEGSKQNRLAVHLQHLTVLPKILQPHWDAYVAIGAPKWHGPEEQDSRWFEPVLWKNFAHVSTAPVEFNETWFGDASGAYIVTGAQLGVWDFGMKSVLHLKLLYSKVPGCTIRRSVWDHTPSGLHQSKGKKGTSSASSSPAAAGSGAPSTTQATQKLSKFVDTTELARGPQDLPGHWLVTGAKLCVEKSNVFLRVKYSLLNY

SEQ ID NO: 777 - protein, 330 aa, Symphoricarpos x chenaultii (Hancock)
MEENAAALHTAINSVGALGRGFDVNFDTRLLYCKGVAGSRVVEIDEEHSWDLRLYDSLVVPNVPREIKNSHETSGRDGFGVCSYHEMAEYFNKKANLSGHVPLGSFNAAFSFTGSKHIDAAATKTLCMDGYFIPLAKVQLNKSPLVLQENVRRAVPTSWDPPALASFIENFGTHIITSVTIGGKDVVYIKQHQSSPLSTTEIKNYVKDIGNQRFSSTESHTSSGQLNYKDKGADPSLFNSQGIYPQPTTAPSLTGNGKEDVTVIFRRRGGDDLVQSHTQWEKTVQYSPDVIEMSFSPITLLLEGIIGKDHLTRAINLYLERKTSQLLVSD

SEQ ID NO: 778 - protein, 513 aa, Hedera helix (Galaxy)
MDEEHTRDLCLYDGLVVPNVSKDVQNSQETIGRDGSGVCNYFEMMEYVNKKANLSENVPLGCFNAAFNFTSCKNIDAAATKTLCLDGFFIPLAKVQLVKSQLALQENVIRAVPASWDPPALASFIENFGTHVIVSVTIGGKDVIYVKQHQSSSLSKVEIKNYVQDIGNQRFSTTENHTTSGLLKYKDKDVTVIFRRRGGDDLEQSHPQWARTVRSSPDVIEMSFFPIIPLLEGVTGKEHLAQAIDLYLEYKPQIEELRYFLEFQVPRIWAPTQDRPLGYQRKEPVCPSLQFSMMGQKLYISQEQVSVGRKPVTGICLCLEGSKQNRLSIHLQHLACLPKILQPYWDTHVAIGAPKWQGPEEQDSRWFEPVKWKNFSHVSTAPIESPETFIGDQSGVYIVTGAQLGVWDFGSRNVLYMKLLFSRLPGCTIRRSLWDHKPNDKLKKLAATGNNCGDSSSGSGETLAGNKLAKFVDMSAMSKGPQDAPGHWLVAGGKLGVQKGKIVLRVKYSLLNY

SEQ ID NO: 779 - protein, 581 aa, Ophioglossum pendulum
MEDDDSALKVSIAVNALQTLGRGFDLTCDIRIIYCKGTEGSRLLEIDEEHTKNLELPGGISIPDVSRDIKCVQGTEKHFSTGVLHFEQMAGYFNEVLSLSGKTASGVFNAVFNFSGSWNSDALATKSLAVDGWSIILYTLSLTRVPLTLIHEVKVAAPYTWDPAVLASFIERYGTHIVTSVSIGGKDVIYVKQHQSSTLTPTDVELHLKELRSVRFSPFGGHISFMMNEKVADQMLFSTQQIRPQPYNSDCSSSFTGKEDITVIYRRRGGNDLVKGHDEWKKTVPTNPDVVTMTFIPITSLLEDGPCKDHLNRAILVYLEYKPPIEELQYFLAFQVARVWAPVQNELGPPRREPVCPALQFSLMGPKLYISTEQVSVGRRPVTGLRLSLEGRNCNRLAVHVQHLTSLPKVLQPHWDAYIAIGAPKWHGPEEQDSRWFEPVLWRNFSHISTAPVEFNETWIGDASGAFVVTGAQLGVWDFGLKSVLYLRLLYSKVPGCTIRRSVWDHTPVSLNQNLKMDSSKVLNTVPTATSQTPKLLKFVDTTEMSRGAQDMPGHWLVTGAKLGVDKSKIFLRVRYSLLNY

SEQ ID NO: 780 - protein, 585 aa, Blechnum brasiliense
MAEENASSRGARVTAVNAVQALGRGFDVTCDIRLLYCKGTPGSRLVVIDDDHTADLKLSDSLVIPNVSTDIKARLDKPSCPSLGVQDFDQMSELFNKKLAIGGKIPSGMFNAMFNFSGSWQVDSSMTKSLAFDGVVIPLYSVHLRAPFILCEEVKKAVPSTWDPAALASFIEKYGTHVIISVDVGGKDIIYVKQHQSSPLTKSEVDLHLKKLVETRFQGMESGVIQAKDKFQELALNPQKNRSQLVHADGSSSLTGKEDITVIYRRRGGDDLVQDHLEWKKTVHSNPDILSMAFFPIVLLLDAGSGREHLIRAIEAHLKYKPPLEELHYFLEFQVPRAWAPAANQVGLPRKEPVCPTLQFSLMGPKLFISTDQVSVGRKPVTGLRLCLEGSKLNRLAVHVQHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHMPTLLQQSKAKRGTSSASPAATAAAAAATQTTQKLSKFVDTTEMARGPQDLPGHWLVTGAKLCVEKSNIFLRVKYSLLNY

SEQ ID NO: 781 - protein, 580 aa, Ophioglossum pendulum
MEDDDSALKVSIAVNALQTLGRGFDLTCDIRIIYCKGTEGSRLLEIDEEHTKNLELPGGISIPDVSRDIKCVQGTEKHFSTGVLHFEQMAGYFNEVLSLSGKTASGVFNAVFNFSGSWNSDALATKSLAVDGWSIILYSLSLTRAPLTLIHEVKAAVPYTWDPAALASFIEKYGTHIVTSVSVGGKDAIYVKQHQSSTLTSTDVELHLKELRSIRFSPYGGHISFLGNEKVADQMLFSTQQILPQPCNSNGSSSFAGKEDITVIYRRRGGNDLVQGHDEWKKTVPTNPDVVTMTFVPITSLLENGPRSDHLSRAILVYLEYKPPIEELQYFLAFQVARVWAPVQNELGPPRREPVCPALQFSLMGPKLYISTEQVSVGRRPVTGLRLSLEGRNCNRLAVHVQHLTSLPKVLQPHWDAYIAIGAPKWHGPEEQDSRWFEPVLWRNFSHISTAPVEFNETWIGDASGAFVVTGAQLGVWDFGLKSVLYLRLLYSKVPGCTIRRSVWDHTPVPLSQHLKVKTSSKTSVSTATSETPKLLKFVDTTEMSRGPQDMPGHWMVTGAKLGVEKSKIFLRVKYSLLNY

SEQ ID NO: 782 - protein, 387 aa, Asplenium prolongatum x Asplenium antiquum (Kurata)
MESDVNQRKDKENSESSSSLTGKEDITVIYRRRGGDDLVQDHVEWKKTVNFNPDILSMAFFPIVLLLDPGTGREHLNRAIEAHLKYKPPLEELHYFLEFHVTRAWAPLANPVGPPRKEPICPGLQFSLMGPKLFINTSQVSVGRKPVTGLRLCLEGSKLNRLAVHVQHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHNPTGQQQSKATKGTSSASPAMGAAALVAATQVTQKLSVCGYVRDGQRPTRPAWPLASHWRKAVRGEEQNLSESEVLSSELLEENWPWRDNSLSLCILKRVCAICRPSRKKKSSASE

SEQ ID NO: 783 - protein, 587 aa, Pellaea rotundifolia
MADEDASLRGAHATALNAIQAVGRGFDVTCDIRLLYCKGTPGSRLVVVDDEHTTDLKLLDGLDIPKVSTDIRARQEKPSRASLGVQDFDQMSELFNKKLNIRGKIPSGLFNSMFSFSGSWQVDASMTKSLALDGVLLPLYSVHLRSPFILCEEVKKAVPSTWDPAALASFIEKYGTHVILSVEVGGKDIVYVKQHQSSSLTKSEVELQLRKLVETRFQGMEMGIADNKLQELPPLSSQKNHSKIVHADGSSSLTGKEDITVIYRRRGGDDLIQDHLEWKKTVYTNPDVLSMSLFPIVFLLDPGPGRENLNRAIEAYTIYKPPLEELQYFLEFQVSRAWAPVANQLGLPRKEPVCPSLQFSLMGPKLFISTDQISVGRKPVTGLRLCLEGSKQNRLAVHLQHLTVLPKILQPHWDAYVAIGAPKWHGPEEQDSRWFEPVLWKNFAHVSTAPVEFNETWFGDASGAYIVTGAQLGVWDFGMKSVLHLKLLYSKVPGCTIRRSVWDHTPSGLHQSKGKKGTSSASSSPAAAGSGAPSTTQATQKLSKFVDTTELARGPQDLPGHWLVTGAKLCVEKSNVFLRVKYSLLNY

SEQ ID NO: 784 - protein, 298 aa, Tupidanthus calyptratus
MEPRKNMSSDALNTTLWNSIQALGRGFDVTSDIRLLYCKGIPGSRLVQINDGVTKDLAVSDGFVVPNVSVDIESSRGEEVTETTAVCSFHEMAIYFNEKSEISGHVPLGSFNAMFNLTGSWQLDAATTKSLAMIGSVIPLYKVELANLDLVLNEEVKRAVPYSWDPASLASFIENYGTHIVTSATVGGRDVVYIRQHQSSPLSVSDIENYVKDIADQRYSGSRSNPSAAPLKYKDKDVTVIFRRRGGDDLEQSHVRWAETVQTSPDVINMTFIPIVSLLEGVPGIKHLACAIELYLEL

SEQ ID NO: 785 - protein, 545 aa, Asplenium nidus var plicatum
MTDEDASSRGAFVTAVNAVQALGRGFDVTCDIRLLYCKGTPGSRLVVIDDDHNTDLRVSDGVVIPNVSPDIRARLEKPYRPSLGVQDFHKMSEEFNKKLFIGGDIPSGMFNAMFNFSGSWQVDSSMTKSLAIDGLVLPLYSVHLRSPFILCEEVKNAVPNTWDPAALASFIEKYGTHIIRSVEIGGKDIIYVKQHPSSTLTKHEVESHLKKLVESRFQAMESDVIRRKDKENSESSSSLTGKEDITVIYRRRGGDDLVQDHVEWKKTVNSNPDILSMAFFPIVLLLDAGSGREHLNRAIEAHLKYKPPLEELHYFLEFHVARAWAPLANPVGPPRKEPICPALQFSLMGPKLFINTSQVSVGRKPVTGLRLSLEGSKLNRLAVHVQHLAVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHTPTGQQQSKGTKGTSSASPAAGTAAALVALLLLLLVACCCCCCCDTGHPETLQVC

SEQ ID NO: 786 - protein, 565 aa, Prostanthera rotundifolia
MASPPTKNFSSLTVSENALTTTLCNSIQALGRGFDVTSDIRLLYCKGAPGSRLVHIDEEQNRNLEISESCVIPNVSVDIECCGGQSSNEKTPVWSFHEMAKYFNGKSGLPGQVPLGGFNAMFNFSGSWQLDAAATKSLAMVGYIIPLFSVKLVKADLILRDEIKRAVPYSWDPASLASFIENYGTHIVTSATIGGRDVVYVRQHQSSPLSASDIENYVKDIGDQRFSDSKVNTNAGSLKYKDKDVTVIFRRRGGDDLEQSYTKWATTVERAPDVINMTFTPIISLLEGVAGIKHLARAIELYLEYKPPIEDLQYFLDFQISRVWAPEQNNLQRKEPVCPSLQFSLMGSKLYISPDQVTVGRKPVTGLKLSLEGIKQNRLTINLQHLVSLPKILQPHWDAHIAIGAPKWQGPEEQDSRWFEPIKWKNFSHVSTAPIEFTDTCIGDLSGVHIVTGAQLGVWDFGAKSVLHLKLLFSKVPGCTIRRSVWDHSPSNLSAPQKPDGSSSSSLSEKGDGSSQTGKLAKIVDMTEMSKGPQDMPGHWLVTGAKLGVDKGRIVLRVKYSLLNY

SEQ ID NO: 787 - protein, 581 aa, Davallia fejeensis
MASEDASLPGARATALNAVQALGRGFDVTCDIRLLYCKGTPGSRLVVVDDHTTDLKVANGLVIHNVSKDIKARLEKPSRAYQGVQDFDQMSELFNKKLFIEGKIPSGMFNAMFNFSGSWQVVDGMHIPLYSVHLRSPFILCDEVKRAVPSTWDPPALASFIEKYGTHIIRSVEVGGKDIIYVKQHPSSNLTKSEVETHLKKLVETRFQGMESGLVHQKDEYQELTLMNQQKNRSQLVHADGSSSLTGKEDITVIYRRRGGDDLVQDPLEWKKTVNSNPDILTMAFFPIVLLLDPGPGREHLHRAIEAHLKYKPPLEELQYFLEFQVTRAWAPLSNQVGLPRKEPVCPSLQFSLMGPKLFISTDQVSVGRKPVTGLRLCLEGSKLNRLAVHVEHLTVLPKILQPHWDAYVAIGAPKWHGPEEQDSRWFEPVLWKNFAHVSTAPVEFSETWFGDASGAYIVTGAQLGVWDFGVKSVLHLKLLYSKVPRCTIRRSVWDHTPIGQQLSKAKKGASSTAAAAVAAAASIGAAATSQAMQKLSKFVDTTEMSRGPQDLPGHWLVTGAKLCVEKSNIFLRVKYSLLNY

SEQ ID NO: 788 - protein, 548 aa, Verbascum chaixii (Vill)
MASMGSENALITTLCNSIQALGRGFDVTSDIRLLYCKGAPGSRLVHINEEQTRNLEISGSYAIPNVSVDIECSQGQSFNNKTPVWSFHEMAKYFNEKSGLPGNIPLGCFNAMFNFSGSRQLDAAATKSLAMVGYVIPLYMVKLAKPNLILRDEIKRAVPYSWDPASLASFIENYGTHIVTSATIGGRDVVYIRQHQSSPLSASDIENYVKDIGDQRFSDSKGNSSAGALKYKDKDVTVIFRRRGGDDLEQSYAKWAKTVEGAPDVITMTFTPIVSLLEGVAGIKHLARAIELYLEYKPPIEDLQYFLDFQISRAWAPEQNNNLQRKEPVCSSLQFSLMGPKLYISPDQVTVGRKPVTGLKLSLEGLKQNRLAINLQHLVSLPKILQPHWGPHMAIGAPRWQGPEEQDSRWFEPIKWKNFSHVSTSPIEYTDTCIGDLSGVHIVTGAQLGVWDFGARSVLHLKLLFSKVPGCTIRRSVWDHSPSNLQNPEGSSSSNESSQVGKLAKIVDMSEMSKGPQDMPGHWLVTGAKLGVDKGRIVLRVKYSLLNY

SEQ ID NO: 789 - protein, 591 aa, Nephrolepis falcata
MADEDASFRGARATAVNAVQALGRGFDVTCDIRLLYCKGTPGSRLVVIDDDNTTDLKVADGLSIPNISTDIRARLERPSRASQGVQDFDQMSELFNKKLCIGGTIPSGMFNAMFNFSGSQQVDSSITKSLAVDGVLIPLYSVHLRPPFILSEEVKRAVPSTWDPPALASFIEKYGTHIIMSVEVGGKDIIYVKQHPSSSLTKPEVDAHLKKLVETRFLGMESGVNQAKEKDLALLNPQKNRSHLVNADGSSSLTGKEDITVIYRRRGGDDLIQDHSEWKKTVNSNPDILSMAFFPIVLLLDAGPGREHLSRAIEAHLNYKPPLEELQYFLEFQVTRAWAPVANQVGLLRKEPVCPSLQFSLMGPKLFINTDQVSVGRKPVTGLRLCLEGSKLNRLAVHVQHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHTPVGQQLNKAKKGASGATAAAAATTAAAAAAAAVTTQTTQKLSKFVDTTEMSRGPQDLPGHWLVTGAKLCVEKSNIFLRVKYSLLNY

SEQ ID NO: 790 - protein, 578 aa, Equisetum arvense
MAEDEPSRTLGTNVIQALGQGFDITSDIRLSYCKGSRLVQIDAEQTSDLVLPGVTASIPQVPTEIQCLPGRTMRHGTGVLDFEKMAQRFNKALSVNGKIPSGLFNAMFSFSGSWRADAHVTKSLALDGWFIMLYNLKLAHSSFKLRGEIKREVPSTWDPSALSSFIERHGTHIVTSVTVGGKDAIYVKQHQSSSLTSMEIESYLKELGDRRFLARSKHSAFEMKEKGAGQSFPPPAQSLLPTSASDSSSSLTGKEDVTVIYRRRGGDDLEQNHEEWKYTIFSNPDVISMTFIPIASLLEGCPGKEHLIRAIDVYLEYKPPIEELQYFLEFQVTKVWAPVQNDGRLPRKEPICPSLQFSLMGPKLFINTEQVSVGRRPVTGLRLSLEGTKANRLCIHIQHLVALPKILRPHWDSYVAIGALKWHGPEEQDSRWFEPIQWKNFSHVSTAPIEFNEAWMVDLSGAHVVTGAQLGVWDFGPKSVLYLRLLYSKVPGCTIRRSVWDHNPVSYHHSDASKDIINNSPVSSSGALQVNKLVKFVDTEEMTRGPHDMPGHWLVTGAKLGVEKSRIFLRAKYSLLNY

SEQ ID NO: 791 - protein, 570 aa, Asplenium australasicum
MADEDSSLRGAFATAVNAVQALGRGFDVTCDIRLLYCKGALGSRLVVIDDDHTADLKLSDGLVIPNVSMDIRARLEKPSCPSLGVQGFDEMSEEFNKKLFIGGDIPSGMFNAMFNFSGSWQVDSSMTKSLAIDGLVLPLYSVHLRSPFILCEEVKNAVPNTWDPAALASFIEKYGTHIIRSVEIGGKDIIYVKQHPSSTLTKHEVESHLKKLVESRFQATESDVIWRKDKENSESSSSLTGKEDITVIYRRRGGDDLVQDHVEWKKTVNSNPDILSMAFFPIVLLLDPGTGREHLNRAIEAHLKYKPPLEELHYLLEFHVTRAWAPLANPAGPSRKEPVCPALQFSLMGPKLFINMSQVSVGRKPVTGLRLCLEGSKLNRLAVHVQHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHAPIGGQQQSKAKGASSASPAALDAAAAATQATQKLSKFVDTSEMARGPQDLPGHWLVTGAKLCVGKSNIFLRVKYSLLNY

SEQ ID NO: 792 - protein, 560 aa, Tupidanthus calyptratus
MEPRKNMSSDALNTTLWNSIQALGRGFDVTSDIRLLYCKGIPGSRLVQINDGVTKDLAVSDGFVVPNVSVDIESSRGEEVTETTAVCSFHEMAIYFNEKSEISGDVPLGSFNAMFNLTGSWQLDAATTKSLAMIGSVIPLYKVELANLDLVLNEEVKRAVPYSWDPASLASFIENYGTHIVTSATVGGRDVVYIRQHQSSPLSVSDIENYVKDIADQRYSESRSHPSAAPLKYKDKDVTVIFRRRGGDDLEQSHIRWAETVQTSPDVINMTFIPIVSLLEGVPGIKHLACAIELYLEYKPPIEDLQYFLEFQIARVWAPEQSNIQRKDPVCPSLHFSLMGPKLYISPDQVTVGRKPVTGLRLTLEGTKQNRLAIHLQHLVSLPKILQPHWDAHMAIGAPKWQGPEEQDSRWFEPIKWKNFSHVSTAPIEHTETCIGDLSGVYIVTGAQFGVWDFGASKSVLHLKLLFSKVPGCTIRRTVWDHSPSNVSGVQRSNGASTSLLHERTTDSSGHIGKLAKIVDMTEMSKGPQDIPGHWLVTGAKLGVDKGKIVLRIKYSLLNY

SEQ ID NO: 793 - protein, 560 aa, Tupidanthus calyptratus
MEPRKNMSSDALNTTLWNSIQALGRGFDVTSDIRLLYCKGIPGSRLVQINDRDAKDLRVSDEFVVPNVSVDIECSKGEKITETTPVCSFHEMAIYFNEKSEISGDVPLGSFNAMFNLTGSWQLDAATTKSLAMIGSVIPLYKVELANLDLVLNEEVKRAVPYSWDPASLASFIENYGTHIVTSATVGGRDVVYIRQHQSSPLSVSDIENYVKDIADQRYSESRSHPSAAPLKYKDKDVTVIFRRRGGDDLEQSHIRWAETVQTSPDVINMTFIPIVSLLEGVPGIKHLACAIELYLEYKPPIEDLQYFLEFQIARVWAPEQSNIQRKDPVCPSLHFSLMGPKLYISPDQVTVGRKPVTGLRLTLEGTKQNRLAIHLQHLVSLPKILQPHWDAHMAIGAPKWQGPEEQDSRWFEPIKWKNFSHVSTAPIEHTETCIGDLSGVYIVTGAQFGVWDFGASKSVLHLKLLFSKVPGCTIRRTVWDHSPSNVSGVQRSNGASTSLLHERTTDSSGHIGKLAKIVDMTEMSKGPQDIPGHWLVTGAKLGVDKGKIVLRIKYSLLNY

SEQ ID NO: 794 - protein, 358 aa, Waldsteinia ternata
MATRSSSSEALRTTLSNTIQALGRGFDVTSDIRLLYCKGAPGSRLVNLNETEAKDLAVSDGVVVPNVPADIQCSSGSRNTERVSVCSFHEMAEYFNKKSGISSRIPLGSFNAMFNFTGSWKVDASATKSLALVGYCIPLYKVDLGAENLVLHDEIKRAVPYTWDPAALASFIENYGTHIVTSATIGGRDVVYIRQHHSSPLSTSDIQSYVKDIGDDRFGDTKGQSSAGPLKYKDKDVTVIFRRRGGDDLEQSHSRWAETVQLAPDVINMTFTPIVSLLEGVPGIKHLSRAIELYLEYKPPIEDLQYFLDFQIAQAWAPEQNNLQRKGPVCSSLQFSLMGPKLYISPDQVSFLILAVPN

SEQ ID NO: 795 - protein, 310 aa, Platycerium hillii
MANEDVSRGARATAINAVQAIGRGFDITCDIRLLYCKGTPGSRLVVIDDDHTADLQVADDLVIQNVSKDIKARIEKPSRAYQGILDFDQMSELFNKKLSIDGKVPSGMFNAMFNFSGSWQVDSSSTKSLATDGMHIPLYSVHLRPPFILCEEVKRAVPSTWDPPALASFIEKYGTHIIRSVEAGGKDIIYMKQHSSSILSKTEVETHLKKLVEARFQDLDLQSNDEELKLSNPQKHRSQLVHADGSSSLTGKEDITVIYRRRGGDDLVQDPREWKKTVKSNPDILTMSFFPIVLLLDPGPGREHLNRAMD

SEQ ID NO: 796 - protein, 588 aa, Elaphoglossum
MAGEDASIRGARGTAVNAVQALGRGFDVTCDIRLLYCKGAPGSRLLVIDDEHTSDLKVLDGLVIPNVSTEIKARPEKPSRPSVGVQDFDQMSELFNKKLLIGGKIPSGLFNAMFNFSGAWQFDSSITKSLALDGVLIPLYSVHLRSPFILLDEVKMAVPSTWDPPALASFIEKYGTHIIISVEVGGKDIIYLKQHPSSSLTNSEVHSHLKKLVETRFQGMEGGANQAQDMFEALAVSNPPKNRSQLVHADGSSLTGKEDITVIYRRRGGDDLVQDHLEWKRTINSNPDILSMSFLPIVLLLDAGSGREHLNRAIEAHLKYKPPLEELQYFLEFQVTRAWAPVANQVGLPRKEPVCPLLQFSLMGPKLYISTDQVSVGRKPVTGLRLCLEGSKLNRLAVHLQHLTVLPKILQPHWDAYVAIGAPKWHGPEEQDSRWFEPVLWKNFAHVSTAPVEFSETWFGDASGAYIVTGAQLGVWDFGLKSVLHLKLLYSKIPGCTIRRSVWDHTPLGQQVGKAKKGTSSAGTAAAATATTAATAAQSTQKLSKFVDTTEMARGPQDLPGHWLVTGAKLCVEKSNIFLRVKYSLLNY

SEQ ID NO: 797 - protein, 573 aa, Sphaeropteris cooperi
MAEDDTSFRGARATALNALQALGRGFDVTCDIRLLYCKGAPAGARLVKIDEENCWDLALSDGLRIPNVSVGIKARQEECKRLSLGVSDFDQMSELFNRKLGIMGKTPLGMFNAMFSFSGSSQIDASMTKSLAVDGWVIPLYSVHLRAPFMLCEEVRKAVPTTWDPSALASFIEKYGTHIIIGVEVGGKDVIYVKQHQSSILTKSEIELHLKRLVETRFQGVENSVFKAEDKLQELAMFTTQKIRSQPLHADGSSSLTGKEDITVIYRRRGGDDLVQDHIEWKKTVYTNPDVLSMSFSSIVLLLEPGSGRDNLNRAIEAYLTYKPPLEELHYFLEFQVPRAWAPVVNQVGPPRKEPVCPPLQFSLMGPKLFISTDQISVGRKPVTGLRLCLEGSKLNRLAIHLQHLTVLPKILQPHWDYGPEEQDSRWFEPVLWKNFAHVSTAPVEFSETWFGDATGAYIVTGAQLGVWDFGPKSVLYMKLLYSKVPGCTIRRSVWDHTPAPSGQQQLKAQKGAPSTGPSSARQSTHKLSKFVDTTDLMRGPEDLPGHWLVTGAKLCVEKSNIFLRVKYSLLNY

SEQ ID NO: 798 - protein, 570 aa, Asplenium australasicum
MADEDASSRGAFVTAVNAVQALGRGFDVTCDIRLLYCKGTPGSRLVVIDDDHNTDLRVSDGVVIPNVSPDIRARLEKPYRPSLGVQDFHKMSEEFNKKLFIGGDIPSGMFNAMFNFSGSWQVDSSMTKSLAIDGLVLPLYSVHLRSPFILCEEVKNAVPNTWDPAALASFIEKYGTHIIRSVEVGGKDTIYVKQHPSSTLTKEEVESHLTKLVESRFQGRESDVIRRKDKENTDSSSSLTGKEDITVIYRRRGGDDLVQDHVDWKKTVNFNPDILSMAFFPIVLLLDPGTGREHLNRAIEAHLKYKPPLEELHYLLEFHVTRAWAPLANPAGPSRKEPVCPALQFSLMGPKLFINMSQVSVGRKPVTGLRLCLEGSKLNRLAVHVQHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHAPIGGQQQSKAKGASSASPAALDAAAAATQATQKLSKFVDTSEMARGPQDLPGHWLVTGAKLCVGKSNIFLRVKYSLLNY

SEQ ID NO: 799 - protein, 511 aa, Polystichum polyblepharum (C.)
MLHVTSDFCTARAHRAQDWLSLMMTTLPISMFRMVWLSQMFLKTLKQGWRNHFAPLMGCKTLIRCQSCSTRNWVSEERSRQECLMPCSIFQDHGSFIEKYGTHIIISVEVGGKDTIYVKQHLSSSLTKSEVDSHVKKLVETRFQGMESGVTQAKDKFQELALTNPQKNRSQLVHDDGSSSLTSKEDITVIYRRRGGDDLVQDHLEWKKTVNTNPDILSMAFFPIVVLLDAGSGREHLNRAIEAHLQYKPPLEELQYFLEFQVTRAWAPVANQVGLPRKEPVCPSLQFSLMGPKLFISTDQVSVGRKPVTGLRLCLEGSKLNRLAVHLQHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHTPIGQQLSKAKKGTSSATAAAAAAATVTQTTQKLSKFVDTTEMARGPQDLPGHWLVTGAKLCVEKSNIFLRVKYSLLNY

SEQ ID NO: 800 - protein, 583 aa, Davallia fejeensis
MASEDASLPGARATALNAVQALGRGFDVTCDIRLLYCKGTPGSRLVVVDDHTTDLKVANGLVIHNVSKDIKARLEKPSRAYQGVQDFDQMSELFNKKLFIEGKIPSGMFNAMFNFSGSWQVVAIDGMHIPLYSVHLRSPFILCDEVKRAVPSTWDPPALASFIEKYGTHIIRSVEVGGKDIIYVKQHPSSNLTKSEVETHLKKLVETRFQGMESGLVHQKDEYQELTLMNQQKNRSQLVHADGSSSLTGKEDITVIYRRRGGDDLVQDPLEWKKTVNSNPDILTMAFFPIVLLLDPGPGREHLHRAIEAHLKYKPPLEELQYFLEFQVTRAWAPLSNQVGLPRKEPVCPSLQFSLMGPKLFISTDQVSVGRKPVTGLRLCLEGSKLNRLAVHVEHLTVLPKILQPHWDAYVAIGAPKWHGPEEQDSRWFEPVLWKNFAHVSTAPVEFSETWFGDASGAYIVTGAQLGVWDFGVKSVLHLKLLYSKVPRCTIRRSVWDHTPIGQQLSKAKKGASSTAAAAVAAAASIGAAATSQAMQKLSKFVDTTEMSRGPQDLPGHWLVTGAKLCVEKSNIFLRVKYSLLNY

SEQ ID NO: 801 - protein, 462 aa, Asplenium antiquum (makino)
MFNAMFNFSGSWQVDSSMTKSLAIDGLVLPLYSVHLRSPFILCEEVKKAVPNIWDPVALASFIEKYGTHIIRSVEVGGKDTIYVKQHPSSTLTKEEVESHLTKLVESRFQGRESDVIRRKDKENTDSSSSLTGKEDITVIYRRRGGDDLVQDHVDWKKTVNFNPDILSMAFFPIVLLLDPGTGREHLNRAIEAHLKYKPPLEELHYLLEFHVTRAWAPLANPAGPSRKEPVCPALQFSLMGPKLFINMSQVSVGRKPVTGLRLCLEGSKLNRLAVHVQHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHAPIGGQQQSKAKGASSASPAALDAAAAATQATQKLSKFVDTSEMARGPQDLPGHWLVTGAKLCVEKSNIFLRVKYSLLNY

SEQ ID NO: 802 - protein, 619 aa, Platycerium bifurcatum var bifurcatum
MANEDVSRGARATAINAVQAIGRGFDITCDIRLLYCKGTPGSRLVVIDDDHTADLQVADDLVIQNVSKDIKARIEKPSRAYQGILDFDQMSELFNKKLSIDGKVPSGMFNAMFNFSGSWQVDSPSTKSLATDGMHIPLYSVHLRPPFILCEEVKRAVPSTWDPPALAIRSVEAGGKDIIYMKQHSSSILSKTEVETHLKKLVEARFQDLDLQSNDEELKLSNPQKHRSQLVHADGSSSLTGKEDITVIYRRRGGDDLVQDPREWKKTVKSNPDILTMSFFPIVLLLDPGPGREHLNRAIDAHLKYKPPLEELQYFLEFQVTRAWAPVANQVGLPRKEPVCPDAHLKYKPPLEELQYFLEFQVTRAWAPVANQVGLPRKEPVCPSLQFSLMGPKLYISTDQVSVGRKPVTGLRLCLEGSKLNRLAVYVEHLTVLPKILQPHWDAYVAIGAPKWHGPEEQDSRWFEPVLWKNFAHVSTAPVEFSETWFGDASGAYIVTGAQLGVWDFGVKSVLHLKLLYSKVPGCTIRRSVWDHTPIGQQVSKAKKGASSAAAAAAGVAAAAIGAAASSTQAMQKLSKLIDTTEMSRGPQDLPGHWLVTGAKLCVEKGNIFLRVKYSLLNY

SEQ ID NO: 803 - protein, 594 aa, Tupidanthus calyptratus
MEPRKNMSSDALNTTLWNSIQALGRGFDVTSDIRLLYCKGIPGSRLVQINDGVTKDLAVSDGFVVPNVSVDIESSRGEEVTETTAVCSFHEMAIYFNEKSEISGHVPLGSFNAMFNLTGSWQLDAATTKSLAMIGSVIPLYKVELANLDLVLNEEVKRAVPYSWDPASLASFIENYGTHIVTSATVGGRDVVYIRQHQSSPLSVSDIENYVKDIADQRYSGSRSNPSAAPLKYKDKDVTVIFRRRGGDDLEQSHVRWAETVQTSPDVINMTFIPIVSLLEGVPGIKHLARAIELYLEYKPPIEDLQYFLEFQIARVWAPEQSNIQRKDPVCPSLHFSLMGPKLYISPDQVTVGRKPVTGLRLTLEGTKQNRLAIHLQHLVSLPKILQPHWDAHMAIGAPKWQGPEEQDSRWFEPIKWKNFSHVSTAPIEHTETCIGDLSGVYIVTGEPIKWKNFSHVSTAPIEHTETCIGDLSGVYIVTGAQFGVWDFGASKSVLHLKLLFSKVPGCTIRRTVWDHSPSNVSGVQRSNGASTSLLHERTTDSSGHIGKLAKIVDMTEMSKGPQDIPGHWLVTGAKLGVDKGKIVLRIKYSLLNY

SEQ ID NO: 804 - protein, 586 aa, Hedera helix (Galaxy)
MGENAAALHTAMNSVQALGKGFDVNFDTRLLYCKGVAGSRIVEIDEEHTRDLCLYDGLVVPNVSKDVHNSQETIGRDGSGVCNYFEMMEYVNKKANLSENVPLGCFNAAFNFTSCKNIDAAATKTLCLDGFFIPLAKVQLVKSQLALQENVIRAVPASWDPPALASFIENFGTHVIVSVTIGGKDVIYVKQHQSSSLSKVEIKNYVQDIGNQRFSTTENHTTSGLLKYKDKGVDPSLYNSQGVHPQPQPRTATSLIGNGKEDVTVIFRRRGGDDLEQSHPQWARTVRSSPDVIEMSFFPIIPLLEGVTGKEHLAQAIDLYLEYKPQIEELRYFLEFQVPRIWAPTQDRPLGYQRKEPVCPSLQFSMMGQKLYISQEQVSVGRKPVTGICLCLEGSKQNRLSIHLQHLACLPKILQPYWDTHVAIGAPKWQGPEEQDSRWFEPVKWKNFSHVSTAPIESPETFIGDQSGVYIVTGAQLGVWDFGSRNVLYMKLLFSRLPGCTIRRSLWDHKPNDKLKKLAATGNNCGDSSSGSGETLAGNKLAKFVDMSAMSKGPQDAPGHWLVAGGKLGVQKGKIVLRVKYSLLNY

SEQ ID NO: 805 - protein, 386 aa, Tupidanthus calyptratus
MEENAAALHTAMNSVQALGRGFDVNFDIRLLYCKGVAGSRIVEIDEEHTRDMCLYDGLVVPNVSKDVHNSQETIGRDGSGVCNYFEMVEYINKKANLSENVPVGCFNAAFNFTGCKHIDAAATKTLCLDGFFIPLAKVQLVKSQLVLQENVIRAVPASWDPPALASFIENFGTHVIVSVTIGGKDVIYVKQHQSSPLSKVEIKKYVQDIGNQRFSTTENHTISGLLKYKDKGVDPSLYNSQGVHPQPSTATSLIGNGKEDVTVIFRRRGGDDLEQSHTQWARTVRSSPDVIEMSFFPIIPLLEGVTGKEHLAQAIDLYLEYKPQIEELRYFLEFQVPRIWAPIQDRPPGYQRKEPVCPSLQFSMMGQKLYISQEQVSVGRKPVTGS

SEQ ID NO: 806 - protein, 575 aa, Davallia fejeensis
MASEDASLPGARATALNAVQALGRGFDVTCDIRLLYCKGTPGSRLVVVDDHTTDLKVANGLVIHNVSKDIKARLEKPSRAYQGVQDFDQMSELFNKKLFIEGKIPSGMFNAMFNFSGSWQVESLAIDGMHIPLYSVHLRSPFILCDEVKRAVPSTWDPPALASFIEKYGTHIIRSVEVGGKDIIYVKQHPSSNLTKSEVETHLKKLVETRFQGMESGLVHQKDEKNRSQLVHADGSSSLTGKEDITVIYRRRGGDDLVQDPLEWKKTVNSNPDILTMAFFPIVLLLDPGPGREHLHRAIEAHLKYKPPLEELQYFLEFQVTRAWAPLSNQVGLPRKEPVCPSLQFSLMGPKLFISTDQVSVGRKPVTGLRLCLEGSKLNRLAVHVEHLTVLPKILQPHWDAYVAIGAPKWHGPEEQDSRWFEPVLWKNFAHVSTAPVEFSETWFGDASGAYIVTGAQLGVWDFGVKSVLHLKLLYSKVPRCTIRRSVWDHTPIGQQLSKAKKGASSTAAAAVAAAASIGAAATSQAMQKLSKFVDTTEMSRGPQDLPGHWLVTGAKLCVEKSNIFLRVKYSLLNY

SEQ ID NO: 807 - protein, 592 aa, Cissus discolor (blume)
MADFPAPVPPSLSSLLKNSDFSSLSIDYPATTTSGSGRNALISTLCNSIQALGRGFDVTSDIRLLYCKGTPGSRPVIVDEENTRDLVVSDGLVIPNVSVDIEVSRGKRTQETTPVCGFHEMAQHFNELSGISGNVPLGSFNAMFNFTGSRHVDAAATKSLAMVGYYIPLFTVELANSNLTLREEIKRAIPFSWDPASLASFIENYGTHIVTSATVGGRDVVYVRQHQSSPLSLSDIENYVKDIGDQRFLDPKSQPTSAPLKYKDKDVTVIFRRRGGDDLEQSHAKWAETVELAPDVINMTFVPIVSLLDDVPGLKHLSRAVDLYLEYKPPIEDLQYFLEFQIARIWAPELNKLQRKEPVCPSLQFSLMGPKLYISPDQVTIGRKPVTGLRLSLEGSKQNRLAIHLQHLVSLPKILQPHWDAHMAIGAPKWQGPEEQDSRWFEPIKWKNFSHVSTAPIEHTETCIGDLSGVHIVTGAQLGVWDFGAKSVLYLKLLFSKVPGCTIRRSVWDHSPSTPSTSQKPDGSSSSLLTEKTEDKKGDSSSQTGKLIKIVDITEMCKGPQDIPGHWLVTGAKLGVDKGKIVLRIKYSLLNY

SEQ ID NO: 808 - protein, 408 aa, Tupidanthus calyptratus
MGENAAALHTAMNSVQALGRGFDVNFDIRLLYCKGVAGSRIVEIDEEHTRDMCLYDGLVVPNVSKDVHNSQETIGRDGSGVCNYFEMVEYINKKANLSENVPVGCFNAAFNFTGCKHIDAAATKTLCLDGFFIPLAKVQLVKSQLVLQENVIRAVPASWDPPALASFIENFGTHVIVSVTIGGKDVIYVKQHQSSSLSKVEIKNYAQDIGNYVKQHQSSPLSKVEIKKYVQDIGNQRFSTTENHTTSGLLKYKDKGVDPSLYNSQGVHPQPSTATSLIGNGKEDVTVIFRRRGGDDLEQSHTQWARTVRSSPDVIEMSFFPIIPLLEGVTGKEHLAQAIDLYLEYKPQIEELRYFLEFQVPRIWAPIQDRPPGYQRKEPVCPSLQFSMMGQKLYISQEQVSVGRKPVT

SEQ ID NO: 809 - protein, 583 aa, Ophioglossum pendulum
MEEDDNDSALKASIVVNALQTLGRGFDLTCDIRIIYCKGTERSRLIEIDEEHTKTLEVPGGISIPNVSRDIKCVQGTEEHFSTGVLDFEQMAGYFNEVLSLSGKTASGVFNAVFNFSGSWNSDALATKSLAVDGWSIILYSLSLTRAPLTLIHEVKAAVPYTWDPAALASFIEKYGTHIVTSVSVGGKDAIYVKQHQSSTLTSTDVELHLKELRSIRFSPYGGHISFLGNEKVADQMLFSTQQILPQPCNSNGSSSFAGKEDITVIYRRRGGNDLVKGHDEWKKTVPTNPDVVTMTFIPITSLLEDGPCKDHLNRAILVYLEYKPPIEELQYFLAFQVARVWAPVQNELGPPRREPVCPALQFSLMGPKLYISTEQVSVGRRPVTGLRLSLEGRNCNRLAVHVQHLTSLPKVLQPHWDAYIAIGAPKWHGPEEQDSRWFEPVLWRNFSHISTAPVEFNETWIGDASGAFVVTGAQLGVWDFGLKSVLYLRLLYSKVPGCTIRRSVWDHTPVSLNQNLKMDSSKVLNTVPTATSQTPKLLKFVDTTEMSRGAQDMPGHWLVTGAKLGVDKSKIFLRVRYSLLNY

SEQ ID NO: 810 - protein, 563 aa, Pandorea pandorana (Golden Showers)
MDSSPKKDLSSGGGFTVSENALIITLLNSIQALGRGFDVTSDIRLLYCKGTPGSRLVNIDEGQTRNLEISESYAIPDVSVDIECSRGKSSSEKTPVWSFHEMAKYFNEKSSVPGNIPLGSFNAMFNFSGSWQLDAAATKSLAMVGYVIPLFRVKLANPNLALRDEIKRAVPYSWDPASLASFIENYGTHIVTSATIGGRDVGYIRQHQSSPLSISDIENYVKDIGDQRFSDSKTNTSAGALKYKDKDVTVIFRRRGGDDLEQSYAKWATTVEGAPDVINMTFTPIVSLLEGVAGIKHLTRAIELYLEYKPPIEDLQYFLDFQISRVWAPEQNNLQRREPVCSSLQFSLMGPKLYISPDQVTVGRKPVTGLKLSLEGIKQNRLAINLQHLVSLPKILQPHWDAHMAIGAPRWQGPEEQDSRWFEPIKWKHFSHVSTAPIEYTDTCIGDLSGVHIVTGAQLGVWDFGAKSVLHLKLLFSKVPGCTIRRSVWDHSPSNLSQKHDGSSSSSLSNEKGEVGKLAKIMDMTEMSKGPQDMPGHWLVTGAKLGVDKGKIVLRVKYSLLNY

SEQ ID NO: 811 - protein, 577 aa, Equisetum
MASWELNIIYGSSVPWVWESIGGGIDTIHYMIKSWTDQEVDHCGLPCSKIRAGLYQVPTEIKCLPGRIMRHGTGVLDFEKMAQRFNKALSVNGKIPSGLFNAMFSFSGSWRADAHVTKSLALDGWFIMLYNLKLAQSSFKLRGEIKREVPSTWDPAALASFIERHGTHIVTSVTVGGKDAIYVKQHQSSSLTSMEIESYLKELGDRRFLARSKHSAFEMKEKGAGQSFPPPAQSLLPTSASDSSSSLTGKEDVTVIYRRRGGDDLVQNHEEWKYTIFSNPDVISMTFIPIASLLEGCPGKEHLIRAIDIYLEYKPPIEELQYFLEFQVAKVWAPVQNEGRLPRKEPVCPSLQFSLMGPKLYINTEQVSVGRRPVIGLRLCLEGSKVNRLSVHVLHLVALPKLLQPHWDSYVAIGPPKWHGPEEQDSRWFEPIQWKNFSHVSTAPIEYSEGWMGDDSGAHVVTGAQLGVWDFGPKSVLHLRLLYSKVPGCTIRRSIWDYNPNPSSFNPSINPSKASKEANASSSSNAPQVNKLAKFVDTEEMVKGPQDMPGHWLVTGAKLGVEKSKIFLRVKYSLLNY

SEQ ID NO: 812 - protein, 391 aa, Pandorea pandorana (Golden Showers)
MDSSPKKDLSSGGGFTVSENALIITLLNSIQALGRGFDVTSDIRLLYCKGTPGSRLVNIDEGQTRNLEISESYAIPDVSVDIECSRGKSSSEKTPVWSFHEMAKYFNEKSSVPGNIPLGSFNAMFNFSGSWQLDAAATKSLAMVGYVIPLFRVKLANPNLALRDEIKRAVPYSWDPASLASFIENYGTHIVTSATIGGRDVGYIRQHQSSPLSISDIENYVKDIGDQRFSDSKTNTSAGALKYKDKDVTVIFRRRGGDDLEQSYAKWATTVEGAPDVINMTFTPIVSLLEGVAGIKHLTRAIELYLEYKPPIEDLQYFLDFQISRVWAPEQNNLQRREPVCSSLQFSLMGPKLYISPDQVYYSELLYSVHRYVAFSFVSSSVPQSDFLCHD

SEQ ID NO: 813 - protein, 357 aa, Tupidanthus calyptratus
MEPRKNMSSDALNTTLWNSIQALGRGFDVTSDIRLLYCKGIPGSRLVQINDGVTKDLAVSDGFVVPNVSVDIESSRGEEVTETTAVCSFHEMAIYFNEKSEISGHVPLGSFNAMFNLTGSWQLDAATTKSLAMIGSVIPLYKVELANLDLVLNEEVKRAVPYSWDPASLASFIENYGTHIVTSATVGGRDVVYIRQHQSSPLSVSDIENYVKDIADQRYSESRSHPSAAPLKYKDKDVTVIFRRRGGDDLEQSHIRWAETVQTSPDVINMTFIPIVSLLEGVPGIKHLARAIELYLEYKPPIEDLQYFLEFQIARVWAPEQSNIQRKDPVCPSLHTYRGFTIFLGISNCSSLGPRAE

SEQ ID NO: 814 - protein, 438 aa, Platycerium bifurcatum
MAEVKRAVPSTWDPPALASFIEKYGTHIIRSVEAGGKDIIYMKQHSSSILSKTEVETHLKKLVEARFQDLDLQSNDEELKLSNPQKHRSQLVHADGSSSLTGKEDITVIYRRRGGDDLVQDPREWKKTVKSNPDILTMSFFPIVLLLDPGPGREHLNRAMDAHLKYKPPLEELQYFLEFQVTRAWAPVANQVGLPRKEPVCPSLQFSLMGPKLYISTDQVSVGRKPVTGLRLCLEGSKLNRLAVHVEHLTVLPKILQPHWDAYVAIGAPKWHGPEEQDSRWFEPVLWKNFAHVSTAPVEFSETWFGDASGAYIVTGAQLGVWDFGVKSVLHLKLLYSKVPGCTIRRSVWDHTPIGQQVSKAKKGASSAAAAAAGVAAAAIGAAASSTQAMQKLSKLIDTTEMSRGPQDLPGHWLVTGAKLCVEKGNIFLRVKYSLLNY

SEQ ID NO: 815 - protein, 368 aa, Tupidanthus calyptratus
MEPRKNMSSDALNTTLWNSIQALGRGFDVTSDIRLLYCKGIPGSRLVQINDRDAKDLRVSDEFVVPNVSVDIECSKGEKITETTPVCSFHEMAIYFNEKSEISGDVPLGSFNAMFNLTGSWQLDAATTKSLAMIGSVIPLYKVELANLDLVLNEEVKRAVPYSWDPASLASFIENYGTHIVTSATVGGRDVVYIRQHQSSPLSVSDIENYVKDIADQRYSESRSHPSAAPLKYKDKDVTVIFRRRGGDDLEQSHIRWAETVQTSPDVINMTFIPIVSLLEGVPGIKHLACAIELYLEYKPPIEDLQYFLEFQIARVWAPEQSNIQRKDPVCPSLHFSLMGPKLYISPDQVPCLVFNTLLLNCCYEPMV

SEQ ID NO: 816 - protein, 444 aa, Lygodium flexuosum
MAEEDILFRGARSTALNAIQALGRGFDVTCDIRLLYCKGTAGTHLVKVDEDHKGDLELPKGLRIPNVSIDIKARPEKCTRHSLGVLEFDQMSEAFNKLLAIPGKTPLGMFNAMFSFSGSWQADAASTKRLAVDGWIIPLYSVHLRPPFILCEEVKKTVPSSWDPAALASFIEKYGTHIIISVEVGGKDVIYVKQHQSSTLSKSEIEMHLKRLVETRFHGAQNSYMETEEKVEEPAIFTSHKIRSQPTHADSSSSLTGKEDITVIYRRRGGDDLIQDHFEWRDSIFGNPDVLTMSFFPIVLLLDSGSGMENLTRAIEAYLKYKPPLEELQYFLEFLAPRAWAPVASQVGPPRKEPVCPFLQFSLMGQKLFISTDQVSVGRKPITGLRLSLEGSKLNRLAFQRPGHLWPAKLALPEKNLYAHFYSLVSWVRSSSSVQIRFLLAGSQ

SEQ ID NO: 817 - protein, 469 aa, Asplenium antiquum (makino)
MFNAMFNFSGSWQVDSSLTKRLAVDGLVLPLYSVHLRSPFILCEEVKKAVPNIWDPVALASFIEKYGTHIIRSVEVGGKDTIYVKQHPSSTLTKEEVESHLTKLVESRFQGRESDVIRRKDKENTDSSSSLTGKEDITVIYRRRGGDDLVQDHVDWKKTVNFNPDILSMAFFPIVLLLDPGTGREHLNRAIEAHLKYKPPLEELHYLLEFHVTRAWAPLANPAGPSRKEPVCPALQFSLMGPKLFINMSQVSVGRKPVTGLRLCLEGSKLNRLAVHVQHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHTPTGQQQSKGTKGTSSASPAAGTAAAPAAAAAAAATPATQKLSKFVDMSEMARGPQDLPGHWLVTGAKLCVEKSNIFLRVKYSLLNY

SEQ ID NO: 818 - protein, 561 aa, Asplenium nidus var plicatum
MTDEDASSRGAFVTAVNAVQALGRGFDVTCDIRLLYCKGTPGSRLVVIDDDHNTDLRVSDGVVIPNVSPDIRARLEKPYRPSLGVQDFHKMSEEFNKKLFIGGDIPSGMFNAMFNFSGSWQVDSSMTKSLAIDGLVLPLYSVHLRSPFILCEEVKNAVPNTWDPAALASFIEKYGTHIIRSVEIGGKDIIYVKQHPSSTLTKHEVESHLKKLVESRFQAMESDVIRRKDKENSESSSSLTGKEDITVIYRRRGGDDLVQDHVEWKKTVNSNPDILSMAFFPIVLLLDAGSGREHLNRAIEAHLKYKPPLEELHYFLEFHVARAWAPLANPVGPPRKEPICPALQFSLMGPKLFINTSQVSVGRKPVTGLRLSLEGSKLNRLAVHVQHLAVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHTPTGQQQSKGTKGTSSASPAAGTAAALVALLLLLLVALLLLLLVALLLLLLVACCCCCCCDTGHPETLQVC

SEQ ID NO: 819 - protein, 304 aa, Symphoricarpos x chenaultii (Hancock)
MDDALTTTLFNSIQALGRGFDVTSDIRLLYCKGAPGSRLIHLDDQHVKDLVLNDGFVVPNVSVDVECSTGNRNPETISVCSFHEMAKYFNEKSDISGHVPLGSFNSMFNFTGSRQIDAAATKSLAMIGYVIPLYKVKLSISNLVLHEDVNRAVPYSWDPASLASFIENYGTHIVTSATVGGRDIVYIRQHQSSPLSAPDIDNYVKDIGDQRFSEVKGHQSAGPLKYKDKDVTVIFRRRGGDDLEQSHSKWSETVRRAPDVINMTFTPIASLLEGVPGIKHLARAIDLYLECKYSSCFSLFPLLV

SEQ ID NO: 820 - protein, 560 aa, Tupidanthus calyptratus
MEPRKNMSSDALNTTLWNSIQALGRGFDVTSDIRLLYCKGIPGSRLVQINDGVTKDLAVSDGFVVPNVSVDIESSRGEEVTETTAVCSFHEMAIYFNEKSEISGHVPLGSFNAMFNLTGSWQLDAATTKSLAMIGSVIPLYKVELANLDLVLNEEVKRAVPYSWDPASLASFIENYGTHIVTSATVGGRDVVYIRQHQSSPLSVSDIENYVKDIADQRYSESRSHPSAAPLKYKDKDVTVIFRRRGGDDLEQSHIRWAETVQTSPDVINMTFIPIVSLLEGVPGIKHLARAIELYLEYKPPIEDLQYFLEFQIARVWAPEQSNIQRKDPVCPSLHFSLMGPKLYISPDQVTVGRKPVTGLRLTLEGTKQNRLAIHLQHLVSLPKILQPHWDAHMAIGAPKWQGPEEQDSRWFEPIKWKNFSHVSTAPIEHTETCIGDLSGVYIVTGAQFGVWDFGASKSVLHLKLLFSKVPGCTIRRTVWDHSPSNVSGVQRSNGASTSLLHERTTDSSGHIGKLAKIVDMTEMSKGPQDIPGHWLVTGAKLGVDKGKIVLRIKYSLLNY

SEQ ID NO: 821 - protein, 376 aa, Phormium (Lancer Terra Cotta)
MEKNKNEKAAALIATLWNSVQALGRGFDVTADTRLLYCKGAAGSRFVQIGEGQIRDFVVTEGGAVLRDVPVDVEISRERRVRDTTRVCSFREMAEYFNKKSGLFETVPLGSFNSMFSLTGSWKIDAAATKTLAMDGYFIPLFKVKLTDPALILREDIKRAVPRSWDPPSLANFIENFGTHIITSVKIGGKDVVYIKQHHSSLLSTSDIEKYLTEIGDQRFSDLENQFADALLLNNRDGRPQLSSVPHLSGKEDVTVIFRRRGGDDLVQNHAEWAATVSSAPDVINMTFIPIVSLLEGLPGIQYLARAIDLYLDYKPPIEELQYFLEFQIQRVWHAIFFQIHLKLNSMKSHALIAIHKYKHIQSETSGTESNISNSR

SEQ ID NO: 822 - protein, 579 aa, Verbascum chaixii (Vill)
MEENAAALHTAINSVQALGRGFDVNCDTRLLYCKGVAGSRIVDIDEEHPRDLYLSDNLVVPNVSRDIKSSVEAGGRDGFGVCSYSEMVEYFNRKADLSGQTPLGSFNVAFSYTGSKHIDAASTKSLCMDGFFIPLAKIQLVKASMSLNENVRRAVPTSWDPPGLASFIENFGTHVITSVTIGGKDVIYVKQHLSSPLAMVEIKNYVQDIGNQRFSSPEGLTNSGLLRYKDKGSDPSLFNSQGIYPQPASAPYLSWSGKEDVTVIFRRRGGDDLEQSHIQWVQTVRSSPDVIEMSFFPITELLDGVRGKEHLARAIALYLEYKPQIEELRYFLEFQVPRIWAPVSDRFPGQPRKEPVCPSLQFSMMGQKLYVSQEQVSVGRKPVTGMRLCLEGSKQNRLSIHLQHLASLPKILQPHWDTHMAIGAPKWQGPEEQDSRWFEPVKWKKFSHVSTAPIENPETFIDDVTGVYIVTGAQLGVWDFGSRNVLHMKLLYSKLPGCTIRRSLWDHAPDENQKKQNSDESSSSSGENYVGNKLAKFVEMSEMSKGPENHPGHWLVTGGKLGVEKGRIVVRVKYSLLNY

SEQ ID NO: 823 - protein, 388 aa, Tupidanthus calyptratus
MGENAAALHTAMNSVQALGRGFDVNFDIRLLYCKGVAGSRIVEIDEEHTRDMCLYDGLVVPNVSKDVHNSQETIGRDGSGVCNYFEMVEYINKKANLSENVPVGCFNAAFNFTGCKHIDAAATKTLCLDGFFIPLAKVQLVKSQLVLQENVIRAVPASWDPPALASFIENFGTHVIVSVTIGGKDVIYVKQHQSSSLSKVEIKNYAQDIGNQRFSTTENHTTSGLLKYKDKGVDPSLYNSQGVHPQPSTATSLIGNGKEDVTVIFRRRGGDDLEQSHTQWARTVRSSPDVIEMSFFPIIPLLEGVTGKEHLAQAIDLYLEYKPQIEELRYFLEFQVPRIWAPIQDRPPGYQRKEPVCPSLQFSMMGQKLYISQEQVRFCVFVNTLLSW

SEQ ID NO: 824 - protein, 608 aa, Tupidanthus calyptratus
MEENAAALHTAMNSVQALGRGFDVNFDIRLLYCKGVAGSRIVEIDEEHTRDMCLYDGLVVPNVSKDVHNSQETIGRDGSGVCNYFEMVEYINKKANLSENVPVGCFNAAFNFTGCKHIDAAATKTLCLDGFFIPLSKVQLIKSQLVLQENVIDGFFIPLAKVQLVKSQLVLQENVIRAVPASWDPPALASFIENFGTHVIVSVTIGGKDVIYVKQHQSSPLSKVEIKKYVQDIGNQRFSTTENHTISGLLKYKDKGVDPSLYNSQGVHPQPSTATSLIGNGKEDVTVIFRRRGGDDLEQSHTQWARTVRSSPDVIEMSFFPIIPLLEGVTGKEHLAQAIDLYLEYKPQIEELRYFLEFQVPRIWAPIQDRPPGYQRKEPVCPSLQFSMMGQKLYISQEQVSVGRKPVTGMRLCLEGSKQNRLIIHLQHLACLPKILQPYWDTHVSIGAPKWQGPEEQDSRWFEPVKWKNFSHVSTAPIECPETFVGDQSGVYIVTGAQLGVWDFGSRNVLYMKLLFSRLPGCTIRRSLWDHKPNEESKKSAATGNNSGDSSSASGETLAGNKIAKSVDMSAMSKGPQDAPGHWLVTGGKLGVEKGKIVLRVKYSLLNY

SEQ ID NO: 825 - protein, 531 aa, Equisetum
MASWELNIIYGSSVPWVWESIGGGIDTIHYMIKSWTDQEVDHCGLPCSKIRAGLYQMAQRFNKALSVNGKIPSGLFNAMFSFSGSWRADAHVTKSLALDGWFIMLYNLKLAQSSFKLRGEIKREVPSTWDPAALASFIERHGTHIVTSVTVGGKDAIYVKQHQSSSLTSMEIESYLKELGDRRFLARSKHSAFEMKEKGAGQSFPPPAQSLLPTSASDSSSSLTGKEDVTVIYRRRGGDDLVQNHEEWKYTIFSNPDVISMTFIPIASLLEGCPGKEHEFQVAKVWAPVQNDGRLPRKEPICPSLQFSLMGPKLFINTEQVSVGRRPVTGLRLSLEGTKANRLCIHVQHLVALPKILRPHWDSYLAIGAPKWHGPEEQDSRWFEPIQWKNFSHVSTAPIEFNEAWMVDVSGAHVVTGAQLGVWDFGPKSVLHLRLLYSKVPGCTIRRSIWDYNPNPSSFNPSINPSKASKEANASSSSNAPQVNKLAKFVDTEEMVKGPQDMPGHWLVTGAKLGVEKSKIFLRVKYSLLNY

SEQ ID NO: 826 - protein, 587 aa, Aglaomorpha (Roberts)
MANEDACRGARATAVNAVQAIGRGFDVTCDIRLLYCKGTPGSRLVVIDDDDTVDLKVADDLVIQNVSKDIKVRFEKPSRAYQGVQDFDQMSELFNKKLFIEGKVPSGMFNAMFNFSGSWQVDSSITKSLAIDGMHIPLYSVHLRPPFILCDEVKRAVPSSWDPPALASFIEKYGTHIIRSVEVGGKDIIYVKQHPSSSLTKPEVETHLKKLVEARFQDLDIQSNDEELTFSNPQKNRSQLVHADGSSSLTSKEDITVIYRRRGGDDLVQDPREWKKTVKSNPDILTMSFFPIVLLLDPGPGREHLIRAIDAHLKYKPPLEELQYFLEFQVTRAWAPVANQVGIPRKEPVCPSLQFSLMGPKLYISTDQVSVGRKPVTGLRLCLEGSKLNRLAVHAEHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHTPLGQQVSKAKKGASSAAAAAAGVAAAAIGAAASTTQAMQKLSKFVDTTEMSRGPQDLPGHWLVTGAKLCVEKGNIFLRVKYSLLNY

SEQ ID NO: 827 - protein, 576 aa, Stenochiaena tenuifolia
MADEDASSRGARGTAVNAVQALGRGFDVTCDIRLLYCKGTPGSRLVVIDDEHTADLKLCDSLVISNAPTDVKARLDNPSCTFQGVQDFDQMSELFNKKLGIGGTIPSGTFNAMFNFSGSWQVDSSITKSLAVDGVVIPLYSLHLKAPFILCEEVKKAVPSVWDPAALASFIEKNGTHVIIGVEVGGKDIIYVKQHQSSSLTKTEVDLHLKKLVEMRFQEKESKEPALPPQKNRSQFVHADGPSSLTGKEDITVIYRRRGGDDLIQDHLEWKKSVHSNPDILSMTFFPIVLLLDAGSGREHLNRAIEAYLRYKPPLEELHFFLEFQVPRAWAPVASQVVLPRKEPVCPTLQFSLMGPKLFINTDQVSVGRRPVTGLCLCLEGSKFNRLAVHVQHLTVLPKILQPHWDAYVAIGAPKWHGPEEQDSRWFEPVLWKNFAHVSTAPVEFSETWFGDASGAYIVTGAQLGVWDFGVKSVLHLKLLYSKVPGCTIRRSVWDHTPTGLQQSKAKTGMSSTSATSAAATTTAMQTTQKLSKFVDTTEMARGPEDLPGHWVVTGAKLCVEKSNIFLRVKYSLLNY

SEQ ID NO: 828 - protein, 583 aa, Ophioglossum pendulum
MEEDDNDSALKTSIVVNALQTLGRGFDLTCDIRIIYCKGTERSRLIEIDEEHTKTLEVPGGISIPNVSRDIKCVQGTEEHFSTGVLDFEQMAGYFNEVLSLSGKTASGVFNAVFNFSGSWNSDALATKSLAVDGWSIILYSLSLTRAPLTLIHEVKAAVPYTWDPAALASFIEKYGTHIVTSVSVGGKDAIYVKQHQSSTLTSTDVELHLKELRSIRFSPYGGHISFLGNEKVADQMLFSTQQILPQPCNSNGSSSFAGKEDITVIYRRRGGNDLVQGHDEWKKTVPTNPDVVTMTFVPITSLLENGPRSDHLSRAILVYLEYKPPIEELQYFLAFQVARVWAPVQNELGPPRREPVCPALQFSLMGPKLYISTEQVSVGRRPVTGLRLSLEGRNCNRLAVHVQHLTSLPKVLQPHWDAYIAIGAPKWHGPEEQDSRWFEPVLWRNFSHISTAPVEFNETWIGDASGAFVVTGAQLGVWDFGLKSVLYLRLLYSKVPGCTIRRSVWDHTPVSLNQNLKMDSSKVLNTVPTATSQTPKLLKFVDTTEMSRGAQDMPGHWLVTGAKLGVDKSKIFLRVRYSLLNY

SEQ ID NO: 829 - protein, 253 aa, Tupidanthus calyptratus
MEPRKNMSSDALNTTLWNSIQALGRGFDVTSDIRLLYCKGIPGSRLVQINDRDAKDLRVSDEFVVPNVSVDIECSKGEKITETTPVCSFHEMAIYFNEKSEISGDVPLGSFNAMFNLTGSWQLDAATTKSLAMIGSVIPLYKVELANLDLVLNEEVKRAVPYSWDPASLASFIENYGTHIVTSATVGGRDVVYIRQHQSSPLSVSDIENYVKDIADQRYSESRSHPSAAPLKYKDKDSLYQAASIITFISIRH

SEQ ID NO: 830 - protein, 421 aa, Asplenium prolongatum x Asplenium antiquum (Kurata)
MADEDASLRGAFATAVNAVQALGRGFDVTCDIRLLYCKGTPGTRLVVIDDDHTTDLKLSDGLVIPNVSTDIRARLEKPSRPSLGVRGFDEMSEEFNKKLSIGGNIPSGMFNAMFNFSGSWQVDSSMTKRLAVDGLVLPLYSVHLRSPFILCEEVKKAVPNIWDPAALASFIEKYGTHIIRSVDVGGKDITYVKQHSSSTLTKEDVESHLKKLVESRFQGRESDVIRRKDKENTDSSSSLTGKEDITVIYRRRGGDDLVQDHVEWKKTVNFNPDILSMAFFPIVLLLDPGTGREHLNRAIEAHLKYKPPLEELHYFLEFHVTRAWAPLVNPAGPPKKEPVCPALQFSLMGPKLFINTSQVSVGRKPVTGLCLCLEGSKLNRLAVLVQHLTVLPKILQPHWDAYVAIGAPKWHGPEEQDSRWF

SEQ ID NO: 831 - protein, 565 aa, Phormium (Lancer Terra Cotta)
MEKNKNEKAAALIATLWNSVQALGRGFDVTADTRLLYCKGAAGSRFVQIGEGQIRDFVVTEGGAVLRDVPVDVEISRERRVRDTTRVCSFREMAEYFNKKSGLFETVPLGSFNSMFSLTGSWKIDAAATKTLAMDGYFIPLFKVKLTDPALILREDIKRAVPRSWDPPSLANFIENFGTHIITSVKIGGKDVVYIKQHHSSLLSTSDIEKYLTEIGDQRFSDLENQFADALLLNNRDGRPQLSSVPHLSGKEDVTVIFRRRGGDDLVQNHAEWAATVSSAPDVINMTFIPIVSLLEGLPGIQYLARAIDLYLDYKPPIEELQYFLEFQIQRVWPPAPSNIPGHQRKEPVCPFLQFSLMGPKLYISSEQISVGRKPVTGLRLCLEGIKQDRLAIHLQHLASLPKILRPHWDSHIAIGAPKWQGPEEQDSRWFEPIKWKNFAHVSTAPIQNTETNIGDLSGVYIVTGAQLGVWDFGAKSVLHLKLLFSKVPGCTIRRSVWDHSPSISRPQRPDEPSSSSGDNSSQLGKLAKIVDSTEMSKGPQDTPGHWLVTGAKLGVIYFSSTETR

SEQ ID NO: 832 - protein, 300 aa, Tupidanthus calyptratus
MEPRKNMSSDALNTTLWNSIQALGRGFDVTSDIRLLYCKGIPGSRLVQINDGVTKDLAVSDGFVVPNVSVDIESSRGEEVTETTAVCSFHEMAIYFNEKSEISGHVPLGSFNAMFNLTGSWQLDAATTKSLAMIGSVIPLYKVELANLDLVLNEEVKRAVPYSWDPASLASFIENYGTHIVTSATVGGRDVVYIRQHQSSPLSVSDIENYVKDIADQRYSESRSHPSAAPLKYKDKDVTVIFRRRGGDDLEQSHIRWAETVQTSPDVINMTFIPIVSLLEGVPGIKHLACAIELYLECKI

SEQ ID NO: 833 - protein, 323 aa, Ophioglossum pendulum
MEDDDSALKVSIAVNALQTLGRGFDLTCDIRIIYCKGTEGSRLLEIDEEHTKNLELPGGISIPDVSRDIKCVQGTEKHFSTGVLHFEQMAGYFNEVLSLSGKTASGVFNAVFNFSGSWNSDALATKSLAVDGWSIILYSLSLTRAPLTLIHEVKAAVPYTWDPAALASFIEKYGTHIVTSVSVGGKDAIYVKQHQSSTLTSTDVELHLKELRSIRFSPYGGHISFLGNEKVADQMLFSTQQILPQPCNSNGSSSFAGKEDITVIYRRRGGNDLVKGHDEWKKTVPTNPDVVTMTFIPITSLLEDGPCKDHLNRAILVYLESGS

SEQ ID NO: 834 - protein, 321 aa, Equisetum
MAEDEDPVVDPCRSLAVSAIQAMGRGFDLTCDIRLSYCKGVSPLVLLDQQNKKDLWLPGGISIPDAPAEIQCLHGRTSRHGTDVLNFDQMSERFNKALSIEGKIPSGLFNAMFSFSGSWRADASTTKSLALDGWFSTLYNLKLAKHSLKLHDEVKREVPSTWDPEALASFIEKHGTHIVTSVTVGGKDTIYVKQHQSNNISHHPLCLWKLNYLKELGDRRFLAGSSNSALDLNDKAAGQSSPITGPNLVQTLGSDGPSSLTGKEDVTVIYRRRGGDDLVQNHEEWKATIKSSPDVISMTFIPIASLLEGCPGKEHLICNTS

SEQ ID NO: 835 - protein, 289 aa, Rumohra adiantiformis
MADEDASFRGARGTAVNAVQALGRGFDVTCDIRLLYCKGTPGSRLVVIDDNHTTNLKVSDGLVIPDVSTDIKARLEKPSRPSLGVQDFDQMSELFNNKLGIGGKIPSGMFNAMFNFSGSWQVDSSITKGLALDGVFIPLYSVHLRSPFILRDEVKMAVPSTWDPPALASFIEKYGTHIIISVEVGGKDIVYVKQHPSSSLTKSEVDSHLRKLVETRFQGMESGVNQAKDKFQLVHADGSSSLTGKEDITVIYRRRGGDDLVQRRDQVSRHGKWCKSSKRQGKEVSVLHW

SEQ ID NO: 836 - protein, 581 aa, Vernonia noveboracensis
MEENAAALHTANNSVQALGKGFDVNFDTRLLYCKGVAGFKVVEIDEEHKRDIWLYDNLVVPNVSRDIENYQDPVNRISSGICSYHEMVEYFNKRANLSGNIPLGSFNAAFSFTGSKHIDAAATKTLCMDGYFIPLVKFELTKSNLVLQETVKRAVPTSWDPPALASFIENFGTHVITSITIGGKDVIYVKQHLSSSLSTIEIKNYVQDIGNQRFSNTENLTDSGLLRYKEKGGDPSLFSSQGVYPQPTSSSSLGGNAKEDVTVIFRRRGGDDLEQSHSQWEKTVKYSPDVIGMSFVPMASLLEGLPGKEHLTRAIDLYLEYKPQIEELRYFLEFQVPRVWAPLQDRLPGHQRKEPVCPSLQFSMMGQKLYVSQEQISVGRKPVTGIRLCLEGSKQNRLSIHLQHLQSLPKILRPYWDTHVAIGAPKWLGPEEQDSRWFEPVKWKNFSHVSSAPIESPESFIGDLSGVHIVTGAQLGVWDFGSRNVLYMKLLYSRLPGCTVRRSLWDHSPTDKSKRSAGPGNSVGDSSSGSSSSNKLAKFIDMAEMSKGPADPPGHWVVTGGKLGVEKGKIVLRLKYSLLNY

SEQ ID NO: 837 - protein, 472 aa, Asplenium antiquum (makino)
MFNAMFNFSGSWQVDSSMTKSLAIDGLVLPLYSVHLRSPFILCEEVKKAVPNIWDPVALASFIEKYGTHIIRSVEIGGKDIIYVKQHPSSTLTKHEVESHLKKLVESRFQATESDVIRRKDKENSESSSSLTGKEDITVIYRRRGGDDLVQDHVEWKKTVNSNPDILSMAFFPIVLLLDAGSGREHREHLNRAIEAHLKYKPPLEELHYFLEFHVARAWAPLANPVGPPRKEPICPALQFSLMGPKLFINTSQVSVGRKPVTGLRLCLEGSKLNRLAVHVQHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHTPTGQQQSKGTKGTSSASPAAGTAAAPAAAAAAAATPATQKLSKFVDMSEMARGPQDLPGHWLVTGAKLCVGKSNIFLRVKYSLLNY

SEQ ID NO: 838 - protein, 338 aa, Rumohra adiantiformis
MADEDASFRGARGTAVNAVQALGRGFDVTCDIRLLYCKGTPGSRLVVIDDNHTTNLKVSDGLVIPDVSTDIKARLEKPSRPSLGVQDFDQMSELFNNKLGIGGKIPSGMFNAMFNFSGSWQVDSSITKGLALDGVFIPLYSVHLRSPFILRDEVKMAVPSTWDPPALASFIEKYGTHIIISVEVGGKDIVYVKQHPSSSLTKSEVDSHLRKLVETRFQGMESGVNQAKDKFQLVHADGSSSLTGKEDITVIYRRRGGDDLVQDHLEWKKTVNLNPDILSMAFFPIVLLLDAGSGREHVNRAIEAHLKYKPPLEELQFFLEFQVSRAWAPAANQPLRLI

SEQ ID NO: 839 - protein, 584 aa, Sphaeropteris cooperi
MAEDDALLRGARGIALNAVQALGRGFDVTCDIRLLYCKGAPAGARLVKIDEENCWDLALSDGLRIPNVSVGIKARQEECKRLSLGVSDFDQMSELFNRKLGIMGKTPLGMFNAMFSFSGSSQIDASMTKSLAVDGWVIPLYSVHLRAPFMLCEEVRKAVPTTWDPSALASFIEKYGTHIIIGVEVGGKDVIYVKQHQSSILTKSEIELHLKRLVETRFQGVENSVFKAEDKLQELAMFTTQKIRSQPLHADGSSSLTGKEDITVIYRRRGGDDLVQDHFEWRKTVHSNPDVLSMSFFPIVGLLEPGSNVDNLNRAIDAYLTYKPPLEELQYFLEFQVPRAWAPVVNQVGPPRKEPVCPPLQFSLMGPKLFISTDQISVGRKPVTGLRLCLEGSKLNRLAVHVQHLTVLPKILQPHWDAYVAIGAPKWHGPEEQDSRWFEPVLWKNFAHVSTAPVEFNETWFGDASGAYIVTGAQLGVWDFGLKSVLHLKLLYSKVPGCTIRRSVWDHTPAPSGQQQQPKAKKGALSISSAAVPQTTQKLSKFVDTTELMRGPQDLPGHWLVTGAKLCVEKSNIFLRVKYSLLNY

SEQ ID NO: 840 - protein, 498 aa, Microsorum musifolium (Blume)
MSELFNKKLFIEGKVPSGMFNAMFNFSGSWQVDSSITKSLAIDGMHIPLYSVHLRPPFILCEEVKRAVPSTWDPPALASFIEKYGTHIIRSVEVGGKDIIYMKQHSSSTLSKAEVETHLKKLVEARFQDLDNQLNDEELTLSNPQKYRSQLVHADSSSSLTGKEDITVIYRRRGGDDLVQDPREWKKTVKSNPDILTMTFFPIVLLLDPGPNREHLIRAIDAHLKYKPPLEELQYFLEFQVTRAWAPVANQVGVPRKEPVCPSLQFSLMGPKLYISTDQVSVGRKPVTGLRLCLEGSKLNRLAVHVEHLTVLPKILQPHWDAYVAIGAPKWHGPEEQDSRWFEPVLWKNFAHVSTAPVEFSETWFGDASGAYIVTGAQLGVWDFGVKSVLHLKLLYSKVPGCTIRRSVWDHTPIGQQVSKAKKGASSAAAAAAGVAAAAIGAATSTTQTMQKLSKLIDTTEMSRGPQDLPGHWLVTGAKLCVEKGNIFLRVKYSLLNY

SEQ ID NO: 841 - protein, 587 aa, Platycerium wandae
MANEDVSRGARATAINAVQAIGRGFDITCDIRLLYCKGTPGSRLVVIDDDHTADLQVADDLVIQNVSKDIKARIEKPSRAYQGILDFDQMSELFNKKLSIDGKVPSGMFNAMFNFSGSWQVDSSSTKSLATDGMHIPLYSVHLRPPFILCEEVKRAVPSTWDPPALASFIEKYGTHIIRSVEAGGKDIIYMKQHSSSILSKTEVETHLKKLVEARFQDLDLQSNDEELKLSNPQKHRSQLVHADGSSSLTGKEDITVIYRRRGGDDLVQDPREWKKTVKSNPDILTMSFFPIVLLLDPGPGREHLNRAMDAHLKYKPPLEELQYFLEFQVTRAWAPVANQVGLPRKEPVCPSLQFSLMGPKLYISTDQVSVGRKPVTGLRLCLEGSKLNRLAVYVEHLTVLPKILQPHWDAYVAIGAPKWHGPEEQDSRWFEPVLWKNFAHVSTAPVEFSETWFGDASGAYIVTGAQLGVWDFGVKSVLHLKLLYSKVPGCTIRRSVWDHTPIGQQVSKAKKGASSAAAAAAGVAAAAIGAAASSTQAMQKLSKLIDTTEMSRGPQDLPGHWLVTGAKLCVEKGNIFLRVKYSLLNY

SEQ ID NO: 842 - protein, 323 aa, Phormium (Lancer Terra Cotta)
MEENAALRTIRSSIQALGRGFDVNYDTRLLYCKGVGGSRVVEVDEEHTRDVLAFEGLIVPGVSRDVRCFQEGRSRQSTGVCTYTEMIEYFNRKALLPGNVPLGSFNSVFCFSGSRKIDAAATRSLAMDGIFIPLCKVQLIKQPSSLQEDVRRAVPLTWEPSSLARFIENYGTHVITSITVGGKDEIYVKQHSSSPLSTIEIKNYIQDIGDQRFSDSESHTSSGPMKLKDKAADPFSFNSQGVYPQPPTAPYLNSKEDVTVIFRRRGGDDLVQSHYHWAKTVSFAPDVIQMTFLPITSLLDGIPWKDHLIRAITLYLECRNLDL

SEQ ID NO: 843 - protein, 324 aa, Asplenium prolongatum x Asplenium antiquum (Kurata)
MAEGDSSSRGAFVTGVNAVQALGRGFDATCDIRLLYCKGTPGTRLVVIDDDHTTDLKVSDGVVIPNVSTDIRARLEKPYRPSLGVQGFHEMSEEFNKKLSIGGNIPSGMFNAMFNFSGSWQVDSSMTKRLAVDGLVLPLYSVHLRSPFILCEEVKKAVPNIWDPAALASFIEKYGTHIIRSVDVGGKDIIYVKQHPSSTLTKHEVESHLKKLVESRFQAMESDVNQRKDKENSESSSSLTGKEDITVIYRRRGGDDLVQDHVEWKKTVNFNPDILSMAFFPIVLLLDPGTGREHLNRAIEAHLKYKPPLEELHYFLEFHVTRAW

SEQ ID NO: 844 - protein, 587 aa, Platycerium bifurcatum
MANEDVSRGARATAINAVQAIGRGFDITCDIRLLYCKGTPGSRLVVIDDDHTADLQVADDLVIQNVSKDIKARIEKPSRAYQGILDFDQMSELFNKKLSIDGKVPSGMFNAMFNFSGSWQVDSSSTKSLATDGMHIPLYSVHLRPPFILCEEVKRAVPSTWDPPALASFIEKYGTHIIRSVEAGGKDIIYMKQHSSSILSKTEVETHLKKLVEARFQDLDLQSNDEELKLSNPQKHRSQLVHADGSSSLTGKEDITVIYRRRGGDDLVQDPREWKKTVKSNPDILTMSFFPIVLLLDPGPGREHLNRAMDAHLKYKPPLEELQYFLEFQVTRAWAPVANQVGLPRKEPVCPSLQFSLMGPKLYISTDQVSVGRKPVTGLRLCLEGSKLNRLAVHVEHLTVLPKILQPHWDAYVAIGAPKWHGPEEQDSRWFEPVLWKNFAHVSTAPVEFSETWFGDASGAYIVTGAQLGVWDFGVKSVLHLKLLYSKVPGCTIRRSVWDHTPIGQQVSKAKKGASSAAAAAAGVAAAAIGAAASSTQAMQKLSKLIDTTEMSRGPQDLPGHWLVTGAKLCVEKGNIFLRVKYSLLNY

SEQ ID NO: 845 - protein, 267 aa, Symphoricarpos x chenaultii (Hancock)
MEENAAALHTAINSVGALGRGFDVNFDTRLLYCKGVAGSRVVEIDEEHSWDLRLYDSLVVPNVPREIKNSHETSGRDGFGVCSYHEMAEYFNKKANLSGHVPLGSFNAAFSFTGSKHIDAAATKTLCMDGYFIPLAKVQLNKSPLVLQENVRRAVPTSWDPPALASFIENFGTHIITSVTIGGKDVVYIKQHQSSPLSTTEIKNYVKDIGNQRFSSTESHTSSGQLNYKDKASSVMFLFSFSFSYSYFLFCLNLNLQSVSFSEFVGG

SEQ ID NO: 846 - protein, 355 aa, Verbascum chaixii (Vill)
MASMGSENALITTLCNSIQALGRGFDVTSDIRLLYCKGAPGSRLVHINEEQTRNLEISGSYAIPNVSVDIECSQGQSFNNKTPVWSFHEMAKYFNEKSGLPGNIPLGCFNAMFNFSGSRQLDAAATKSLAMVGYVIPLYMVKLAKPNLILRDEIKRAVPYSWDPASLASFIENYGTHIVTSATIGGRDVVYIRQHQSSPLSASDIENYVKDIGDQRFSDSKGNSSAGALKYKDKDVTVIFRRRGGDDLEQSYAKWAKTVEGAPDVITMTFTPIVSLLEGVAGIKHLARAIELYLEYKPPIEDLQYFLDFQISRAWAPEQNNNLQRKEPVCSSLQFSLMGPKLYISPDQVYIHILS

SEQ ID NO: 847 - protein, 264 aa, Waldsteinia ternata
MGENVAALNTAVNSVQAIGRGFDVNFDTRLLYCKGVAGSRVLEVDDEHTRDLCVYDDVIVPNVSREINLYQESSERRSSGVCSYNEMVEYFNQKSNISGGYPVGSFNFSFSFTGSKHVDMAATKTLSVDGFYIPLAKFQLLKTPLMLQENVTQAIPNCWDPTSLASFIENFGTHVITSVTIGGKDVIYVKQHHSSPLSTMEIKNYIQDIGNQRFANTESRTSSGQMNFMDKASSTLFHSLSVLFVIFFSVILFLFCLFNVKFKF

SEQ ID NO: 848 - protein, 578 aa, Didymochlaena truncatula
MADEDASFRGAHGTAVNAVQALGRGFDVTCDIRLLYCKGTPGSRLVVLDDELAGDLKISDGLVIPNVSKDIKSRLEKPSRPSQGVQDFDQMSELFNKKLGIGGKIPSGMFNAMFNFSGSWEVDSSITKGLAIDGVLIPLYSVHLRPPFILCEEVKRAVPSTWDPPALASFIEKYGTHIIMSVEVGGKDFIYVKQHPSSSLSKSEVDSHLKKLVETRFQGMESGVTQGTDKFQDLALSNPQKNRSQLVHADGSSSLTGKEDITVIYRRRGGDDLVQDHSEWKKTVFSNPDILSMAFFPIVLLLDAGSGREHLNRAIEAHLKYKPPLEELQYFLEFQVTRAWAPVANQVGLPRKEPVCPSLQFSLMGPKLFISTDQVSVGRKPVTGLRLCLEGSKLNRLAVHVEHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHTPTQLSKAKKGTSSATAAAASQTTQKLSKFVDTTEMARGPQDLPGHWLVTGAKLCVEKSNIFLRVKYSLLNY

SEQ ID NO: 849 - protein, 588 aa, Adiantum hispidulum
MAVDGASYRGAHSTALNALQALGRGFDVTCDIRLLHCKGSPGSRLVVVDDEHTAELKVLDSLGIPKVSTDIRARPEKPSRPSLGVQDFDQMSELFNKKLCIGGKIPSGIFNAMFSFSGSWQVDAAMTKSLALDGVSLPLYSVHLRPPFILREEVEKAVPSAWDPAALASFIEKYGTHIIMSVEVGGKDIVYVKQHQSSSLTKTEVELQLRKLVETRFQGTETSIAEVENKFQELPPLSSHKNHSKTVHAEGSSSLTGKEDITVIYRRRGGDDLVQDHLEWKKTVFTNPDVLSMSFFPIALLLDSGPGQEILNRAIEAYMIYKPPLEELQYFLEFQVPKAWAPVTNQSGPPRKEPVCPSLQFSLMGPKLFINTDQVSVGRKPVTGLRLCLEGSKLNRLAVHVQHLTVLPKILQPHWDAYVTIGAPKWHGPEEQDSRWFEPVLWKNFAHVSTAPVEFSETWFGDASGAYIVTGAQLGVWDFGMKSVLHLKLLYSKVPDCTIRRSVWDQLPNGLQQSKGKKGTSSASSPAVSSDGTSSATQTSMKLSKFVDTTELARGPQDLPGHWLVTGAKLGVEKSNVFLRVKYSLLNY

SEQ ID NO: 850 - protein, 594 aa, Blechnum gibbum
MAEENASSRGARVTAVNAVQALGRGFDVTCDIRLLYCKGTPGSRLVVIDDDHTADLKLSDSLVIPNVSTDIKARLDKPSFPSPGVQDFDQMSELFNKKLAIGGKIPSGMFNAMFNFSGSWQVDSSMTKSLAFDGVVIPLYSVHLRAPFILCEEVKKAVPTTWDPAALASFIEKYGTHVIISVDVGGKDIIYVKQHQSSPLTKSEVDLHLKKLVETRFQGMESGVIQAKDKFQELALNPQKNRSQLVHADGSSSLTGKEDITVIYRRRGGDDLVQDHLEWKKTVHSNPDILSMAFFPIVLLLDAGSGREHLIRAIEAHLKYKPPLEELHYFLEFQVPRAWAPAANQVGLPRKEPVCPTLQFSLMGPKLFISTDQVSVGRKPVTGLRLCLEGSKLNRLAVHVQHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHTPTLLQQSKGKTGTSSASPARFLVVPSGGRYGIIRPRCYNKARERRGHLVRVLLPLPPRLLRHKRLRNSPSLLILRRWQEVRKTCLVTG

SEQ ID NO: 851 - protein, 571 aa, Davallia fejeensis
MASEDASLPGARATALNAVQALGRGFDVTCDIRLLYCKGTPGSRLVVVDDHTTDLKVANGLVIHNVSKDIKARLEKPSRAYQGVQDFDQMSELFNKKLFIEGKIPSGMFNAMFNFSGSWQVVDGMHIPLYSVHLRSPFILCDEVKRAVPSTWDPPALASFIEKYGTHIIRSVEVGGKDIIYVKQHPSSNLTKSEVETHLKKLVETRFQGMESGLVHQKDEKNRSQLVHADGSSSLTGKEDITVIYRRRGGDDLVQDPLEWKKTVNSNPDILTMAFFPIVLLLDPGPGREHLHRAIEAHLKYKPPLEELQYFLEFQVTRAWAPLSNQVGLPRKEPVCPSLQFSLMGPKLFISTDQVSVGRKPVTGLRLCLEGSKLNRLAVHVEHLTVLPKILQPHWDAYVAIGAPKWHGPEEQDSRWFEPVLWKNFAHVSTAPVEFSETWFGDASGAYIVTGAQLGVWDFGVKSVLHLKLLYSKVPRCTIRRSVWDHTPIGQQLSKAKKGASSTAAAAVAAAASIGAAATSQAMQKLSKFVDTTEMSRGPQDLPGHWLVTGAKLCVEKSNIFLRVKYSLLNY

SEQ ID NO: 852 - protein, 308 aa, Tupidanthus calyptratus
MEPRKNMSSDALNTTLWNSIQALGRGFDVTSDIRLLYCKGIPGSRLVQINDGVTKDLAVSDGFVVPNVSVDIESSRGEEVTETTAVCSFHEMAIYFNEKSEISGHVPLGSFNAMFNLTGSWQLDAATTKSLAMIGSVIPLYKVELANLDLVLNEEVKRAVPYSWDPASLASFIENYGTHIVTSATVGGRDVVYIRQHQSSPLSVSDIENYVKDIADQRYSGSRSNPSAAPLKYKDKDVTVIFRRRGGDDLEQSHVRWAETVQTSPDVINMTFIPIVSLLEGVPGIKHLACAIELYLECYSWAKAGNWT

SEQ ID NO: 853 - protein, 588 aa, Adiantum pedatum
MADEDASHRGAHATALNAVQALGRGFDVTCDIRLLYCKGTPGSRLVVVDDEHTADLKVLDGLVIPKVSTDIRPRPEKPSRPSLGVQDFDQMSELFNKRLCIGGKIPSGIFNAMFSFSGSWQVDASMTKSLALDGVDLPLYSVHLRPPFILCEEVKKAVPSTWDPAALASFIEKYGTHIIMSVEVGGKDIVYVKQHQSSSLTKSEVELQLRKLVETRFQGMETAIVDVENKFQELPPLSSQKNQSKIVHADGSSSLTGKEDITVIYRRRGGDDLVQDHLEWKRTVYTNPDVLSMSFFPIVLLLDPGSGRENLNRAIEAYTSYKPPLEELQYFLEFQVPRAWAPVTNQLGLPRKEPVCPSLQFSLMGPKLFISTDQVSVGRKPVTGLRLCLEGSKLNRLAVHVQHLTVLPKILQPHWDAYVAIGAPKWHGPEEQDSRWFEPVLWKNFAHVSTAPVEFSETWFGDASGAYIVTGAQLGVWDFGMKSVLHLKLLYSKVPGCTIRRSVWDHTPTGLQQTKGKKGTSSASSPAVGSSGASSATQASQKLSKFVDTTELARGPQDLPGHWLVTGAKLCVEKSNVFLRVKYSLLNY

SEQ ID NO: 854 - protein, 288 aa, Vernonia noveboracensis
MEENAAALHTANNSVQALGKGFDVNFDTRLLYCKGVAGFKVVEIDEEHKRDIWLYDNLVVPNVSRDIENYQDPVNRISSGICSYHEMVEYFNKRANLSGNIPLGSFNAAFSFTGSKHIDAAATKTLCMDGYFIPLVKFELTKSNLVLQETVKRAVPTSWDPPALASFIENFGTHVITSITIGGKDVIYVKQHLSSSLSTIEIKNYVQDIGNQRFSNTENLTDSGLLRYKEKGGDPSLFSSQGVYPQPTSSSSLGGNAKEVCKAVFFISFLSYGYMMPYLFWVRRLFVI

SEQ ID NO: 855 - protein, 357 aa, Asplenium prolongatum x Asplenium antiquum (Kurata)
MESDVNQRKDKENSESSSSLTGKEDITVIYRRRGGDDLVQDHVEWKKTVNFNPDILSMAFFPIVLLLDPGTGREHLNRAIEAHLKYKPPLEELHYFLEFHVTRAWAPLANPVGPPRKEPICPGLQFSLMGPKLFINTSQVSVGRKPVTGLRLCLEGSKLNRLAVHVQHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHNPTGQQQSKATKGTSSASPAMGAAALVAATQVTQKLSVCGYVRDGQRPTRPAWPLASHWRKAVRGEEQNLSESEVLSSELLEAKWP

SEQ ID NO: 856 - protein, 395 aa, Verbascum chaixii (Vill)
MEENAAALHTAINSVQALGRGFDVNYDTRLLYCKGVAGSRIVDIDEEHPRDLYLSDNLVVPNVSRDIKSSVEAGGRDGFGVCSYSEMVEYFNRKADLSGQTPLGSFNVAFSYTGSKHIDAASTKSLCMDGFFIPLAKIQLVKASMSLNENVRRAVPTSWDPPGLASFIENFGTHVITSVTIGGKDVIYVKQHLSSPLAMVEIKNYVQDIGNQRFSSPEGLTNSGLLRYKDKGSDPSLFNSQGIYPQPASAPYLSWSGKEDVTVIFRRRGGDDLEQSHIQWAKTVRSSPDVIEMSFFPITELLDGVRGKEHLARAISLYLEYKPQIEELRYFLEFQVPRIWAPVSDRFPGQPRKEPVCPSLRVTIQHDGTKAICQPRASFSWTETRDRHATMSRRI

SEQ ID NO: 857 - protein, 493 aa, Ophioglossum pendulum
MAGYFNEVLSLSGKTASGVFNAVFNFSGSWNSDALATKSLAVDGWSIILYTLSLTRVPLTLIHEVKVAAPYTWDPAVLASFIERYGTHIVTSVSIGGKDVIYVKQHQSSTLTPTDVELHLKELRSVRFSPFGGHISFMMNEKVADQMLFSTQQIRPQPYNSDCSSSFTGKEDITVIYRRRGGNDLVKGHDEWKKTVPTNPDVVTMTFIPITSLLEDGPCKDHLNRAILVYLEYKPPIEELQYFLAFQVARVWAPVQNELGPPRREPVCPALQFSLMGPKLYISTEQVSVGRRPVTGLRLSLEGRNCNRLAVHVQHLTSLPKVLQPHWDAYIAIGAPKWHGPEEQDSRWFEPVLWRNFSHISTAPVEFNETWIGDASGAFVVTGAQLGVWDFGLKSVLYLRLLYSKVPGCTIRRSVWDHTPVSLNQNLKMDSSKVLNTVPTATSQTPKLLKFVDTTEMSRGAQDMPGHWLVTGAKLGVDKSKIFLRVRYSLLNY

SEQ ID NO: 858 - protein, 584 aa, Waldsteinia ternata
MGENVAALNTAVNSVQAIGRGFDVNFDTRLLYCKGVAGSRVLEVDDEHTRDLCVYDDVIVPNVSREINLYQESSERRSSGVCSYNEMVEYFNQKSNISGGYPVGSFNFSFSFTGSKHVDMAATKTLSVDGFYIPLAKFQLLKTPLMLQENVTQAIPNCWDPTSLASFIENFGTHVITSVTIGGKDVIYVKQHHSSPLSTMEIKNYIQDIGNQRFANTESRTSSGQMNFMDKGADSGLFNSQGIYPQPTTAPSLAGKEDVTVIFRRRGGDDLEQNHTRWARTVRSSPDVIEMTFFPIAALLEGVTGREHLSRAIGLYLEYKPPIEELRYFLEFQVPRIWAPVYDRNLAHQRKEPVCPSLQFSIMGQKLYVSQEQITVGRKPVTGLRLCLEGSKLNRLCIHLQHLVSLPKILRPYWDSHVAIGAPKWQGPEEQDSRWFEPVKWKNFSHVSTAPIENPETFIGDLSGVHVVTGAQLGVWDFGSKNVLFMKLLYSRLPGCTVRRSLWDHSPNEKSKKGKSSSLNVNAGDSSSGSRENVAGNKLMKLLDMSEMSKGPQDHPGHWLVTGGKLGVEKGKIVLRVKYSLLNY

SEQ ID NO: 859 - protein, 555 aa, Sphaeropteris cooperi
MAEDDTSFRGARATALNALQALGRGFDVTCDIRLLYCKGAPAGARLVKIDEENCWDLALSDGLRIPNVSVGIKARQEECKRLSLGVSDFDQMSELFNRKLGIMGKTPLGMFNAMFSFSGSSQIDASMTKSLAVDGWVIPLYSVHLRAPFMLCEEVRKAVPTTWDPSALASFIEKYGTHIIIGVEVGGKDVIYVKQHKLSILTKSEIELHLKKIVETRFQGMENSVLEAEDKDITVIYRRRGGDDLVQDHFEWRKTVHSNPDVLSMSFFPIVGLLEPGSNVDNLNRAIDAYLTYKPPLEELQYFLEFQVPRAWAPVVNQVGPPRKEPVCPPLQFSLMGPKLFISTDQISVGRKPVTGLRLCLEGSKLNRLAVHVQHLTVLPKILQPHWDAYVAIGAPKWHGPEEQDSRWFEPVLWKNFAHVSTAPVEFNETWFGDASGAYIVTGAQLGVWDFGLKSVLHLKLLYSKVPGCTIRRSVWDHTPAPSGQQQQPKAKKGALSISSAAVPQTTQKLSKFVDTTELMRGPQDLPGHWLVTGAKLCVEKSNIFLRVKYSLLNY

SEQ ID NO: 860 - protein, 394 aa, Waldsteinia ternata
MATRSSSSEALRTTLSNTIQALGRGFDVTSDIRLLYCKGAPGSRLVNLNETEAKDLAVSDGVVVPNVPADIQCSSGSRNTERVSVCSFHEMAEYFNKKSGISSRIPLGSFNAMFNFTGSWKVDASATKSLALVGYCIPLYKVDLGAENLVLHDEIKRAVPYTWDPAALASFIENYGTHIVTSATIGGRDVVYIRQHHSSPLSTSDIQSYVKDIGDDRFGDTKGQSSAGPLKYKDKDVTVIFRRRGGDDLEQSHSRWAETVQLAPDVINMTFTPIVSLLEGVPGIKHLSRAIELYLECKTQSRNSSFLIIVSVSLKNKLKTRSDIEVYSLQFYRFKSYKIPKFLLDKLTSLKNKLKTRSDIEVYSLQFYRFKSYKIPKFLLDKLTDSFIYDPIRT

SEQ ID NO: 861 - protein, 584 aa, Sphaeropteris cooperi
MAEDDTSFRGARATALNALQALGRGFDVTCDIRLLYCKGAPAGARLVKIDEENCWDLALSDGLRIPNVSVGIKARQEECKRLSLGVSDFDQMSELFNRKLGIMGKTPLGMFNAMFSFSGSSQIDASMTKSLAVDGWVIPLYSVHLRAPFMLCEEVRKAVPTTWDPSALASFIEKYGTHIIIGVEVGGKDVIYVKQHQSSILTKSEIELHLKRLVETRFQGVENSVFKAEDKLQELAMFTTQKIRSQPLHADGSSSLTGKEDITVIYRRRGGDDLVQDHFEWRKTVHSNPDVLSMSFFPIVGLLEPGSNVDNLNRAIDAYLTYKPPLEELQYFLEFQVPRAWAPVVNQVGPPRKEPVCPPLQFSLMGPKLFISTDQISVGRKPVTGLRLCLEGSKLNRLAVHVQHLTVLPKILQPHWDAYVAIGAPKWHGPEEQDSRWFEPVLWKNFAHVSTAPVEFNETWFGDASGAYIVTGAQLGVWDFGLKSVLHLKLLYSKVPGCTIRRSVWDHTPAPSGQQQQPKAKKGALSISSAAVPQTTQKLSKFVDTTELMRGPQDLPGHWLVTGAKLCVEKSNIFLRVKYSLLNY

SEQ ID NO: 862 - protein, 533 aa, Platycerium wandae
MANEDVSRGARATAINAVQAIGRGFDITCDIRLLYCKGTPGSRLVVIDDDHTADLQVADDLVIQNVSKDIKARIEKPSRAYQGILDFDQMSELFNKKLSIDGKVPSGMFNAMFNFSGSWQVDSSSTKSLATDGMHIPLYSVHLRPPFILCEEVKRAVPSTWDPPALASFIEKYGTHIIRSVEAGGKDIIYMKQHSSSILSKTEVETHLKKLVEARFQDLDLQSNDEELKLSNPQKHRSQLVHADGSSSLTGKEDITVIYRRRGGDDLVQDPREWKKTVKSNPDILTMSFFPIVLLLDPGPGREHLNRAMDAHLKYKPPLEELQYFLEFQVTRAWAPVANQVGLPRKEPVCPSLQFSLMGPKLYISTDQVSVGRKPVTGLRLCLEGSKLNRLAVYVEHLTVLPKILQPHWDAYVAIGAPKWHGPEEQDSRWFEPVLWKNFAHVSTAPVEFSETWFGDASGAYIVTGAQLGVWDFGVKSVLHLKLLYSKVPGCTIRRSVWDHTPIGQQVSKAKKGASSAAAAAAGVAAAARITLP

SEQ ID NO: 863 - protein, 291 aa, Campyloneurum angustifolium
MANEDASRGAQATAFNAVQALGRGFDVTCDIRLLYCKGSPGSRLVVIDDDHTADLEVADDLVIPNVSKDIKARREKPSRAYQGVQDFDQMSELFNKKLFLEGKVPSGMFNAMFNFSGSWQVDSSITKSLAIDGMHIPLYSVHLRTPFILCDEVKRAVPSTWDPSALASFIEKYGTHIIRSVEVGGKDIIYVKQHPLSSLTKPEVETHLKKLVETRFQNLDIQSNDEELTLLNPQKNRSQLVHADGSSSLTGKEVTILLLPYFTGANFCNIRQTAICCRISRLFIGDEGGMI

SEQ ID NO: 864 - protein, 556 aa, Hedera helix (Galaxy)
MEENAAALHTAMNSVQALGRGFDVNFDTRLLYCKGVAGSRIVEMDEEHTRDLCLYDGLVVPNVSKDVQNSQETIGRDGSGVCNYFEMMEYVNKKANLSENVPLGCFNAAFNFTSCKNIDAAATKTLCLDGFFIPLAKVQLVKSQLALQENVIRAVPASWDPPALASFIENFGTHVIVSVTIGGKDVIYVKQHQSSSLSKVEIKNYVQDIGNQRFSTTENHTTSGLLKYKDKDVTVIFRRRGGDDLEQSHPQWARTVRSSPDVIEMSFFPIIPLLEGVTGKEHLAQAIDLYLEYKPQIEELRYFLEFQVPRIWAPTQDRPLGYQRKEPVCPSLQFSMMGQKLYISQEQVSVGRKPVTGICLCLEGSKQNRLSIHLQHLACLPKILQPYWDTHVAIGAPKWQGPEEQDSRWFEPVKWKNFSHVSTAPIESPETFIGDQSGVYIVTGAQLGVWDFGSRNVLYMKLLFSRLPGCTIRRSLWDHKPNDKLKKLAATGNNCGDSSSGSGETLAGNKLAKFVDMSAMSKGPQDAPGHWLVAGGKLGVQKGKIVLRVKYSLLNY

SEQ ID NO: 865 - protein, 585 aa, Blechnum gibbum
MAEENASSRGARVTAVNAVQALGRGFDVTCDIRLLYCKGTPGSRLVVIDDDHTADLKLSDSLVIPNVSTDIKARLDKPSFPSPGVQDFDQMSELFNKKLAIGGKIPSGMFNAMFNFSGSWQVDSSMTKSLAFDGVVIPLYSVHLRAPFILCEEVKKAVPTTWDPAALASFIEKYGTHVIISVDVGGKDIIYVKQHQSSPLTKSEVDLHLKKLVETRFQGMESGVIQAKDKFQELALNPQKNRSQLVHADGSSSLTGKEDITVIYRRRGGDDLVQDHLEWKKTVHSNPDILSMAFFPIVLLLDAGSGREHLIRAIEAHLKYKPPLEELHYFLEFQVPRAWAPAANQVGLPRKEPVCPTLQFSLMGPKLFISTDQVSVGRKPVTGLRLCLEGSKLNRLAVHVQHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHTPTLLQQSKGKTGTSSASPAATAAAAAATQTTQKLSKFVDTTEMARGPQDLPGHWLVTGAKLCVEKSNIFLRVKYSLLNY

SEQ ID NO: 866 - protein, 553 aa, Equisetum
MASWELNIIYGSSVPWVWESIGGGIDTIHYMIKSWTDQEVDHCGLPCSKIRAGLYQMAQRFNKALSVNGKIPSGLFNAMFSFSGSWRADAHVTKSLALDGWFIMLYNLKLAQSSFKLRGEIKREVPSTWDPAALASFIERHGTHIVTSVTVGGKDAIYVKQHQSSSLTSMEIESYLKELGDRRFLARSKHSAFEMKEKGAGQSFPPPAQSLLPTSASDSSSSLTGKEDVTVIYRRRGGDDLVQNHEEWKYTIFSNPDVISMTFIPIASLLEGCPGKEHLIRAIDIYLEYKPPIEELQYFLEFQVAKVWAPVQNEGRLPRKEPVCPSLQFSLMGPKLYINTEQVSVGRRPVIGLRLCLEGSKVNRLSVHVLHLVALPKLLQPHWDSYVAIGPPKWHGPEEQDSRWFEPIQWKNFSHVSTAPIEYSEGWMGDDSGAHVVTGAQLGVWDFGPKSVLHLRLLYSKVPGCTIRRSIWDYNPNPSSFNPSINPSKASKEANASSSSNAPQVNKLAKFVDTEEMVKGPQDMPGHWLVTGAKLGVEKSKIFLRVKYSLLNY

SEQ ID NO: 867 - protein, 353 aa, Tupidanthus calyptratus
MEPRKNMSSDALNTTLWNSIQALGRGFDVTSDIRLLYCKGIPGSRLVQINDRDAKDLRVSDEFVVPNVSVDIECSKGEKITETTPVCSFHEMAIYFNEKSEISGDVPLGSFNAMFNLTGSWQLDAATTKSLAMIGSVIPLYKVELANLDLVLNEEVKRAVPYSWDPASLASFIENYGTHIVTSATVGGRDVVYIRQHQSSPLSVSDIENYVKDIADQRYSESRSHPSAAPLKYKDKDVTVIFRRRGGDDLEQSHIRWAETVQTSPDVINMTFIPIVSLLEGVPGIKHLACAIELYLEYKPPIEDLQYFLEFQIARVWAPEQSNIQRKDPVCPSLHFSLMGPKLYISPDQVLGT

SEQ ID NO: 868 - protein, 585 aa, Celosia argentea (Sylphid)
MDGNEAALQTAINAIQALGRGFDVNYDTRLLYCKGIAGSTIFQIDEESTWNLRLSNNLIVPNVPKSIKNEPCMPGRESFGVCSYDEMVKHFNKKADILADIPSGSFNSAFNFTGSKHIDAASTKSLAVDGFVIPLAKIQLTKSSWVLQENVIRAIPTSWDPPSLASFIENFGTHVITSVTIGGKDVIYVKQHQSSPLSAMEMKSYVQEIGNQRFMPKESHTSSGPIRVKEKVGDSGLFNSQGIYPQPTSVPSVNGKEDITVIFRRRGGDDLEHSHRQWAMTVKSSPDIIEMTFVPITDLIKDSARKEYLSRAINLYLEYKPAIEELRYFLEFQIPRVWAPVHNRLLRHQRKEPVCPSLQFSLMGQKLYISQEQVSVGRKPVTGLRLFLEGAKQNRLCIHLQHLASLPKILVPCWDTHVAIGAPKWMGPEEQDSRWFEPVKWKNFSHVSTAPIESHESYAGDVSGVHIVTGAQLGVWDFGSRNVLYMKLLYSRLPGCTIRRSLWDHTPIEKPWKAGGSAESTSGDSSSGGLSESVSSGNKLAKFVDMSEVTKGPEDLPGHWLVTGGKLGIEKGKIVLRVKYSLLNY

SEQ ID NO: 869 - protein, 577 aa, Asplenium australasicum
MADEDSSLRGAFATAVNAVQALGRGFDVTCDIRLLYCKGALGSRLVVIDDDHTADLKLSDGLVIPNVSMDIRARLEKPSCPSLGVQGFDEMSEEFNKKLFIGGDIPSGMFNAMFNFSGSWQVDSSMTKSLAIDGLVLPLYSVHLRSPFILCEEVKNAVPNTWDPAALASFIEKYGTHIIRSVEVGGKDTIYVKQHPSSTLTKEEVESHLTKLVESRFQGRESDVIRRKDKENTDSSSSLTGKEDITVIYRRRGGDDLVQDHVDWKKTVNFNPDILSMAFFPIVLLLDAGSGREHLNRAIEAHLKYKPPLEELHYFLEFHVARAWAPLANPVGPPRKEPICPALQFSLMGPKLFINTSQVSVGRKPVTGLRLCLEGSKLNRLAVHVQHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHTPTGQQQSKGTKGTSSASPAAGTAAAPAAAAAAAATPATQKLSKFVDMSEMARGPQDLPGHWLVTGAKLCVGKSNIFLRVKYSLLNY

SEQ ID NO: 870 - protein, 580 aa, Ophioglossum pendulum
MEDDDSALKVSIAVNALQTLGRGFDLTCDIRIIYCKGTEGSRLLEIDEEHTKNLELPGGISIPDVSRDIKCVQGTEKHFSTGVLHFEQMAGYFNEVLSLSGKTASGVFNAVFNFSGSWNSDALATKSLAVDGWSIILYSLSLTRAPLTLIHEVKAAVPYTWDPAALASFIEKYGTHIVTSVSVGGKDAIYVKQHQSSTLTSTDVELHLKELRSIRFSPYGGHISFLGNEKVADQMLFSTQQILPQPCNSNGSSSFAGKEDITVIYRRRGGNDLVKGHDEWKKTVPTNPDVVTMTFIPITSLLEDGPCKDHLNRAILVYLEYKPPIEELQYFLAFQVARVWAPVQNELGPPRREPVCPALQFSLMGPKLYISTEQVSVGRRPVTGLRLSLEGRNCNRLAVHVQHLTSLPKVLQPHWDAYIAIGAPKWHGPEEQDSRWFEPVLWRNFSHISTAPVEFNETWIGDASGAFVVTGAQLGVWDFGLKSVLYLRLLYSKVPGCTIRRSVWDHTPVPLSQHLKVKTSSKTSVSTATSETPKLLKFVDTTEMSRGPQDMPGHWMVTGAKLGVEKSKIFLRVKYSLLNY

SEQ ID NO: 871 - protein, 317 aa, Equisetum
MASWELNIIYGSSVPWVWESIGGGIDTIHYMIKSWTDQEVDHCGLPCSKIRAGLYQMAQRFNKALSVNGKIPSGLFNAMFSFSGSWRADAHVTKSLALDGWFIMLYNLKLAQSSFKLRGEIKREVPSTWDPAALASFIERHGTHIVTSVTVGGKDAIYVKQHQSSSLTSMEIESYLKELGDRRFLARSKHSAFEMKEKGAGQSFPPPAQSLLPTSASDSSSSLTGKEDVTVIYRRRGGDDLVQNHEEWKYTIFSNPDVISMTFIPIASLLEGCPGKEHLIRAIDIYLECIFFFQCLKNQDIIPGVGTMIVYIVVKFG

SEQ ID NO: 872 - protein, 537 aa, Asplenium nidus var plicatum
MADEDSSLRGAFATAVNAVQALGRGFDVTCDIRLLYCKGTPGSRLVVIDDDHTADLKLSDGLVIPNVSMDIRARLEKPYRPSLGVQDFHKMSEEFNKKLFIGGDIPSGMFNAMFNFSGSWQVDSSMTKSLAIDGLVLPLYSVHLRSPFILCEEVKNAVPNTWDPAALASFIEKYGTHIIRSVEIGGKDIIYVKQHPSSTLTKHEVESHLKKLVESRFQGRESDVIRRKDKENTDSSSSLTGKEDITVIYRRRGGDDLVQDHVEWKKTVNFNPDILSMAFFPIVLLLDAGSGREHLNRAIEAHLKYKPPLEELHYFLEFQLTRAWAPLVNPAGPPRKEPVCPALQFSLMGPKLFINTSQVSVGRKPVTGLRLSLEGSKLNRLAVHVQHLAVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHTPTGQQQSKGTKGTSSASPAAGTAAALVACCCCCCCDTGHPETLQVC

SEQ ID NO: 873 - protein, 266 aa, Waldsteinia ternata
MATRSSSSEALRTTLSNTIQALGRGFDVTSDIRLLYCKGAPGSRLVNLNETEAKDLAVSDGVVVPNVPADIQCSSGSRNTERVSVCSFHEMAEYFNKKSGISSRIPLGSFNAMFNFTGSWKVDASATKSLALVGYCIPLYKVDLGAENLVLHDEIKRAVPYTWDPAALASFIENYGTHIVTSATIGGRDVVYIRQHHSSPLSTSDIQSYVKDIGDDRFGDTKGQSSAGPLKYKDKDVTVIFRRRGGDDLEQSHSRSAWNKAFEPCN

SEQ ID NO: 874 - protein, 558 aa, Vernonia noveboracensis
MKDNYYSSMEEDPSSKNNALTTTIKNSIQALGRGFDVTSDIRLLYCKGAPGSRLIYLDDEHTKDLVFSDDGVVTIPNVSVDVEFSKGESTTEATPVWTFHEMAKHFNMKSNLCGDVPLGSFNAMFNFTGSWQLDAASTKSLAMIGYIVPLYEIRLENSDLVLLQEVKRAVPYSWDPSSLASFIENYGTHIVTSVTIGGRDVVYIKQHQSSPLSLSDIDNYVKDIGENRFVDLKSQSSSGPLKYKDKDVTVIFRRRGGDDLEQSHAKWAETVETAPDVINMTFTPIVSLLDGIPGINHLSRAIDLYLEYKPPIEDLQYFLDFRIPRVWAPEQSNIQRKEPVCPSLQFSLMGPKLYISLEQVTVGRKPVTGLRLSLEGSKQNRLAVHLQHLVSLPKILQPHWDAHMAIGAPKWQGPEEQDSRWFEPIKWKNFSHVSTAPIEHTETHIGDLSGVHIVTGAQFGVWNFGARSVLHLKLLFSKVPGCTIRRSVWDHSPSNLPKLGDDKGDGSSQSGKLAKIVDMTEMSKGPQDVPGHWLVTGAKLGVDKGKIVLRIKYSLLNY

SEQ ID NO: 875 - protein, 585 aa, Phormium (Lancer Terra Cotta)
MEENAALRTIRSSIQALGRGFDVNYDTRLLYCKGVGGSRVVEVDEEHTRDVLAFEGLIVPGVSRDVRCFQEGRSRQSTGVCTYTEMIEYFNRKALLPGNVPLGSFNSVFCFSGSRKIDAAATRSLAMDGIFIPLCKVQLIKQPSSLQEDVRRAVPLTWEPSSLARFIENYGTHVITSITVGGKDEIYVKQHSSSPLSTIEIKNYIQDIGDQRFSDSESHTSSGPMKLKDKAADPFSFNSQGVYPQPPTAPYLNSKEDVTVIFRRRGGDDLVQSHYHWAKTVSFAPDVIQMTFLPITSLLDGIPWKDHLIRAITLYLEYKPPIEELRYFLEFQIPLIWAPVRENLPGHQRKDPVCPHLQFSMMGQKLYVSQEQVSVGRKPVTGLRLCLEGEKQNRLCIQVQHLASLPKILQPYWNSHIAIGALKWHGPEEQDSRWFEPVKWKNFSHVSTAPIENSENFIRDPSGVGVHIVTGAQLGVWDFGTKNVLYMKLLYSKVPGCTVRRSLWDHNPACSSEKSKKSSIGPSMTPGDSSSGSRDVAGKLLKLVDMSEMVKGPDDSPGHWLVTGGKLGVEKGKIVLRVKYSLLNY

SEQ ID NO: 876 - protein, 570 aa, Asplenium australasicum
MADEDASSRGAFVTAVNAVQALGRGFDVTCDIRLLYCKGTPGSRLVVIDDDHNTDLRVSDGVVIPNVSPDIRARLEKPYRPSLGVQDFHKMSEEFNKKLFIGGDIPSGMFNAMFNFSGSWQVDSSMTKSLAIDGLVLPLYSVHLRSPFILCEEVKNAVPNTWDPAALASFIEKYGTHIIRSVEVGGKDTIYVKQHPSSTLTKEEVESHLTKLVESRFQGRESDVIRRKDKENTDSSSSLTGKEDITVIYRRRGGDDLVQDHVDWKKTVNFNPDILSMAFFPIVLLLDPGTGREHLNRAIEAHLKYKPPLEELHYLLEFHVTRAWAPLANPAGPSRKEPVCPALQFSLMGPKLFINMSQVSVGRKPVTGLRLCLEGSKLNRLAVHVQHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHAPIGGQQQSKAKGASSASPAALDAAAAATQATQKLSKFVDTSEMARGPQDLPGHWLVTGAKLCVEKSNIFLRVKYSLLNY

SEQ ID NO: 877 - protein, 368 aa, Tupidanthus calyptratus
MEPRKNMSSDALNTTLWNSIQALGRGFDVTSDIRLLYCKGIPGSRLVQINDGVTKDLAVSDGFVVPNVSVDIESSRGEEVTETTAVCSFHEMAIYFNEKSEISGHVPLGSFNAMFNLTGSWQLDAATTKSLAMIGSVIPLYKVELANLDLVLNEEVKRAVPYSWDPASLASFIENYGTHIVTSATVGGRDVVYIRQHQSSPLSVSDIENYVKDIADQRYSGSRSNPSAAPLKYKDKDVTVIFRRRGGDDLEQSHVRWAETVQTSPDVINMTFIPIVSLLEGVPGIKHLARAIELYLEYKPPIEDLQYFLEFQIARVWAPEQSNIQRKDPVCPSLHFSLMGPKLYISPDQVPCLVFNTLLLNCCYEPMV

SEQ ID NO: 878 - protein, 582 aa, Sphaeropteris cooperi
MAEDDALLRGARGIALNAVQALGRGFDVTFDIRLLYCKGAPGTRLVKIDEELCGNLELSDGLCIPNVSLGIKASLGKCTRHCLGVLDFDQMSETFNKQLCIPGKTPLGMFNAMFSFSGSSQIDASMTKSLAVDGWVIPLYSVHLRAPFMLCEEVRKAVPTTWDPSALASFIEKYGTHIIIGVEVGGKDVIYVKQHQSSILTKSEIELHLKRLVETRFQGVENSVFKAEDKLQELAMFTTQKIRSQPLHADGSSSLTGKEDITVIYRRRGGDDLVQDHFEWRKTVHSNPDVLSMSFFPIVGLLEPGSNVDNLNRAIDAYLTYKPPLEELQYFLEFQVPRAWAPVVNQVGPPRKEPVCPPLQFSLMGPKLFISTDQISVGRKPVTGLRLCLEGSKLNRLAVHVQHLTVLPKILQPHWDAYVAIGAPKWHGPEEQDSRWFEPVLWKNFAHVSTAPVEFSETWFGDATGAYIVTGAQLGVWDFGPKSVLYMKLLYSKVPGCTIRRSVWDHTPAPSGQQQLKAQKGAPSTGPSSARQSTHKLSKFVDTTDLMRGPEDLPGHWLVTGAKLCVEKSNIFLRVKYSLLNY

SEQ ID NO: 879 - protein, 476 aa, Blechnum gibbum
MAEENASSRGARVTAVNAVQALGRGFDVTCDIRLLYCKGTPGSRLVVIDDDHTADLKLSDSLVIPNVSTDIKARLDKPSFPSPGVQDFDQMSELFNKKLAIGGKIPSGMFNAMFNFSGSWQVDSSMTKSLAFDGVVIPLYSVHLRAPFILCEEVKKAVPTTWDPAALASFIEKYGTHVIISVDVGGKDIIYVKQHQSSPLTKSEVDLHLKKLVETRFQGMESGVIQAKDKFQELALNPQKNRSQLVHADGSSSLTGKEDITVIYRRRGGDDLVQDHLEWKKTVHSNPDILSMAFFPIVLLLDAGSGREHLIRAIEAHLKYKPPLEELHYFLEFQVPRAWAPAANQVGLPRKEPVCPTLQFSLMGPKLFISTDQVSVGRKPVTGLRLCLEGSKLNRLAVHVQHLTVLPKILQPHWDAYVAIGAPKWHGPEEQDSRWFEPVLWKNFAHVSTAPVDITTPLGCVCGYRGTQVAWTRRAR

SEQ ID NO: 880 - protein, 547 aa, Verbascum chaixii (Vill)
MALPSENALITTLGNSIQALGRGFDVTSDIRLLYCKGAPGSRLVHINEEQTRNLEISGSYAIPNVSVDIECSQGQSFNNKTPVWSFHEMAKYFNEKSGLPGNIPLGCFNAMFNFSGSRQLDAAATKSLAMVGYIIPLFTVKLAKPDLILHDQIKRAVPYSWDPASLASFIENYGTHIVTSATIGGRDVVYIRQHQSSPLSTSDIENYVKDIGDQRFSDSKGNSSAGSLKYKDKDVTVIFRRRGGDDLEQSYEKWAKSVEGAPDVISMTFTPIVSLLEGVPGIKHLARAIELYLEYKPPIEDLQYFLDFQISRAWAPEQNNNLQRKEPVCSSLQFSLMGAKLYISPDQVTVGRKPVTGLKLSLEGIKQNRLAINLQHLVSLPKILQPHWGPHMAIGAPRWQGPEEQDSRWFEPIKWKNFSHVSTSPIEYTDTCIGDLSGVHIVTGAQLGVWDFGARSVLHLKLLFSKVPGCTIRRSVWDHSPSNLQNPEGSSSSNESSQVGKLAKIVDMSEMSKGPQDMPGHWLVTGAKLGVDKGRIVLRVKYSLLNY

SEQ ID NO: 881 - protein, 573 aa, Davallia fejeensis
MASEDASLPGARATALNAVQALGRGFDVTCDIRLLYCKGTPGSRLVVVDDHTTDLKVANGLVIHNVSKDIKARLEKPSRAYQGVQDFDQMSELFNKKLFIEGKIPSGMFNAMFNFSGSWQVVAIDGMHIPLYSVHLRSPFILCDEVKRAVPSTWDPPALASFIEKYGTHIIRSVEVGGKDIIYVKQHPSSNLTKSEVETHLKKLVETRFQGMESGLVHQKDEKNRSQLVHADGSSSLTGKEDITVIYRRRGGDDLVQDPLEWKKTVNSNPDILTMAFFPIVLLLDPGPGREHLHRAIEAHLKYKPPLEELQYFLEFQVTRAWAPLSNQVGLPRKEPVCPSLQFSLMGPKLFISTDQVSVGRKPVTGLRLCLEGSKLNRLAVHVEHLTVLPKILQPHWDAYVAIGAPKWHGPEEQDSRWFEPVLWKNFAHVSTAPVEFSETWFGDASGAYIVTGAQLGVWDFGVKSVLHLKLLYSKVPRCTIRRSVWDHTPIGQQLSKAKKGASSTAAAAVAAAASIGAAATSQAMQKLSKFVDTTEMSRGPQDLPGHWLVTGAKLCVEKSNIFLRVKYSLLNY

SEQ ID NO: 882 - protein, 471 aa, Pandorea pandorana (Golden Showers)
MDSSPKKDLSSGGGFTVSENALIITLLNSIQALGRGFDVTSDIRLLYCKGTPGSRLVNIDEGQTRNLEISESYAIPDVSVDIECSRGKSSSEKTPVWSFHEMAKYFNEKSSVPGNIPLGSFNAMFNFSGSWQLDAAATKSLAMVGYVIPLFRVKLANPNLALRDEIKRAVPYSWDPASLASFIENYGTHIVTSATIGGRDVGYIRQHQSSPLSISDIENYVKDIGDQRFSDSKTNTSAGALKYKDKDVTVIFRRRGGDDLEQSYAKWATTVEGAPDVINMTFTPIVSLLEGVAGIKHLTRAIELYLEYKPPIEDLQYFLDFQISRVWAPEQNNLQRREPVCSSLQFSLMGPKLYISPDQVTVGRKPVTGLKLSLEGIKQNRLAINLQHLVSLPKILQPHWDAHMAIGAPRWQGPEEQDSRWFEPIKWKHFSHVSTAPIEYTDTCIGDLSGVHIVTGAQLGVWDFGAKIPNA

SEQ ID NO: 883 - protein, 582 aa, Campyloneurum angustifolium
MANEDASRGAQATAFNAVQALGRGFDVTCDIRLLYCKGSPGSRLVVIDDDHTADLEVADDLVIPNVSKDIKARREKPSRAYQGVQDFDQMSELFNKKLFLEGKVPSGMFNAMFNFSGSWQVDSSITKSLAIDGMHIPLYSVHLRTPFILCDEVKRAVPSTWDPSALASFIEKYGTHIIRSVEVGGKDIIYVKQHPLSSLTKPEVETHLKKLVETRFQNLDIQSNDEELTLLNPQKNRSQLVHADGSSSLTGKEDITVIYRRRGGDDLVQDPRDWKKTVKSNPDILTMTFFPIVLLLDSGPGKEHLIRAIDAHLKYKPPLEELQYFLEFQVTRAWAPLANQVGISRKEPVCPSLQFSLMGPKLYISTDQVSVGRKPVTGLRLCLEGSKLNRLAVHVEHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHTPIGQHVSKAKKGASSVGAAAVAISAATSTTQTMQKLSKFVDTTEMSRGPQDLPGHWLVTGAKLCVEKGNIFLRVKYSLLNY

SEQ ID NO: 884 - protein, 620 aa, Nephrolepis cordifolia (Duffii)
MADEDASFRGARATAVNAVQALGRGFDVTCDIRLLYCKGTPGSRLVVIDDDSTADLKVADGLAIPNVSTDIRTRLERPSRASQGVQDFDQMSELFNKKLCIGGKIPSGMFNAMFNFSGSWQVDSSITKSLAVDGVLIPLYSVHLRAPFILSEEVKRAVPSTWDPPALASFIEKYGTHIIISVEVGGKDIIYVKQHPSSGLTKPEVDAHLKKLVETRFLGMESGVNQAKEKDLALLNPQKNRSHLVHADGSSSLTGKEDITVIYRRRGGDDLVQDHLEWKKTVNSNPDILSMAFFPIVLLLDASPGREHLNRAIEAHLKYKPPLEELQYFLEFQVTRAWAPVANQVGIPRKEPVCPSLQFSLMGPKLFISTDQVSVGRKPVTGLRLCLEGSKLNRLAVHVEHLTVLPKILQPHWDAYVAIGAPKWHGPEEQDSRWFEPVLWKNFAHVSTAPVEFSETWGPEEQDSRWFEPVLWKNFAHVSTAPVEFSETWFGDASGAYIVTGAQLGVWDFGLKSVLHLKLLYSKVPGCTIRRSVWDHTPVGQQLNKAKKGASGASATAAATTTAASAVTTQTTQKLSKFVDTTEMSRGPQDLPGHWLVTGAKLCVEKSNIFLRVKYSLLNY

SEQ ID NO: 885 - protein, 587 aa, Platycerium bifurcatum var bifurcatum
MANEDVSRGARATAINAVQAIGRGFDITCDIRLLYCKGTPGSRLVVIDDDHTADLQVADDLVIQNVSKDIKARIEKPSRAYQGILDFDQMSELFNKKLSIDGKVPSGMFNAMFNFSGSWQVDSPSTKSLATDGMHIPLYSVHLRPPFILCEEVKRAVPSTWDPPALASFIEKYGTHIIRSVEAGGKDIIYMKQHSSSILSKTEVETHLKKLVEARFQDLDLQSNDEELKLSNPQKHRSQLVHADGSSSLTGKEDITVIYRRRGGDDLVQDPREWKKTVKSNPDILTMSFFPIVLLLDPGPGREHLNRAIDAHLKYKPPLEELQYFLEFQVTRAWAPVANQVGLPRKEPVCPSLQFSLMGPKLYISTDQVSVGRKPVTGLRLCLEGSKLNRLAVYVEHLTVLPKILQPHWDAYVAIGAPKWHGPEEQDSRWFEPVLWKNFAHVSTAPVEFSETWFGDASGAYIVTGAQLGVWDFGVKSVLHLKLLYSKVPGCTIRRSVWDHTPIGQQVSKAKKGASSAAAAAAGVAAAAIGAAASSTQAMQKLSKLIDTTEMSRGPQDLPGHWLVTGAKLCVEKGNIFLRVKYSLLNY

SEQ ID NO: 886 - protein, 302 aa, Verbascum chaixii (Vill)
MASMGSENALITTLCNSIQALGRGFDVTSDIRLLYCKGAPGSRLVHINEEQTRNLEISGSYAIPNVSVDIECSQGQSFNNKTPVWSFHEMAKYFNEKSGLPGNIPLGCFNAMFNFSGSRQLDAAATKSLAMVGYVIPLYMVKLAKPNLILRDEIKRAVPYSWDPASLASFIENYGTHIVTSATIGGRDVVYIRQHQSSPLSASDIENYVKDIGDQRFSDSKGNSSAGALKYKDKDVTVIFRRRGGDDLEQSYAKWAKTVEGAPDVITMTFTPIVSLLEGVAGIKHLARAIELYLECKNLILC

SEQ ID NO: 887 - protein, 577 aa, Asplenium australasicum
MADEDASSRGAFVTAVNAVQALGRGFDVTCDIRLLYCKGTPGSRLVVIDDDHNTDLRVSDGVVIPNVSPDIRARLEKPYRPSLGVQDFHKMSEEFNKKLFIGGDIPSGMFNAMFNFSGSWQVDSSMTKSLAIDGLVLPLYSVHLRSPFILCEEVKNAVPNTWDPAALASFIEKYGTHIIRSVEIGGKDIIYVKQHPSSTLTKHEVESHLKKLVESRFQATESDVIWRKDKENSESSSSLTGKEDITVIYRRRGGDDLVQDHVEWKKTVNSNPDILSMAFFPIVLLLDAGSGREHLNRAIEAHLKYKPPLEELHYFLEFHVARAWAPLANPVGPPRKEPICPALQFSLMGPKLFINTSQVSVGRKPVTGLRLCLEGSKLNRLAVHVQHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHTPTGQQQSKGTKGTSSASPAAGTAAAPAAAAAAAATPATQKLSKFVDMSEMARGPQDLPGHWLVTGAKLCVGKSNIFLRVKYSLLNY

SEQ ID NO: 888 - protein, 548 aa, Verbascum chaixii (Vill)
MASMGSENALITTLCNSIQALGRGFDVTSDIRLLYCKGAPGSRLVHINEEQTRNLEISGSYAIPNVSVDIECSQGQSFNNKTPVWSFHEMAKYFNEKSGLPGNIPLGCFNAMFNFSGSRQLDAAATKSLAMVGYVIPLYMVKLAKPNLILRDEIKRAVPYSWDPASLASFIENYGTHIVTSATIGGRDVVYIRQHQSSPLSASDIENYVKDIGDQRFSDSKGNSSAGALKYKDKDVTVIFRRRGGDDLEQSYAKWAKTVEGAPDVITMTFTPIVSLLEGVAGIKHLARAIELYLEYKPPIEDLQYFLDFQISRAWAPEQNNNLQRKEPVCSSLQFSLMGPKLYISPDQVTVGRKPVTGLKLSLEGLKQNRLAINLQHLVSLPKILQPHWDTHIAIGAPRWQGPEEQDSRWFEPIKWKNFSHVSTSPIECTDTCIGDLSGVHIVTGAQLGVWDFGARSVLHLKLLFSKVPGCTIRRSVWDHSPSNLQKGDGSSSSNESSQMGKLAKIVDMTEMSKGPQDMPGHWLVTGAKLGVDKGKIVLRVKYSLLNY

SEQ ID NO: 889 - protein, 584 aa, Adonis amurensis (Kinsekai)
MEENAAAEAAAFHTVVNSVQALGRGFDVNFDTRLLYCKGVAGARIVQVDGEHTRDLLACDGMVVPNVSRDIKFSQETIGRESKGICPFQEMVGYFNKKADLSGDVPLGSFNSAFSFTGSKKVDAAATKSLSLDGFFVPLCKVEFVNKPSVLQEHVKQAIPSSWDPLALSSFIENFGTHVITSVTVGGKDVIYVKQHNSSPLSTMEIKKYVQDIGDQRFSNTENHASSGPMKFNDKAADPCLFNNQGVYPQPQSSAPYLTGKEDVTVIFRRRGGDDLVQSHIQWVRTVRASPDVIEMTFIPITDLVDSRPCKDHLSRAITLYLEHKPPVEELRYFLEFQIPRVWAPVEDKFLGHQRKEPVCPSLQFSIMGQKLYVSQEQVSVGRKPVTGLRLTLEGAKQNRLHIQLEHLSSLPKILCPYWDTTVAIGAPKWQGTEEQDSRWFEPVKWKNFSHVSTAPIENNETFIGDLSGVHIVTGAQLGVWDFGSRNVLHMKLLYSRLPGCTIRRSLWDHSPPINSKVGGGGGATTNVMNSGSGSSNKLCKIIDTSEMKKGPEDSPGHWLVTGGKLGVEKGRIVLRVKYSVLNY

SEQ ID NO: 890 - protein, 288 aa, Equisetum
MASWELNIIYGSSVPWVWESIGGGIDTIHYMIKSWTDQEVDHCGLPCSKIRAGLYQMAQRFNKALSVNGKIPSGLFNAMFSFSGSWRADAHVTKSLALDGWFIMLYNLKLAQSSFKLRGEIKREVPSTWDPAALASFIERHGTHIVTSVTVGGKDAIYVKQHQSSSLTSMEIESYLKELGDRRFLARSKHSAFEMKEKGAGQSFPPPAQSLLPTSASDSSSSLTGKEDVTVIYRRRGGDDLVQNHEEWKYTIFSNPDVISMTFIPIASLLEGCPGKEHLIRAIDIYLE

SEQ ID NO: 891 - protein, 583 aa, Ophioglossum pendulum
MEEDDNDSALKASIVVNALQTLGRGFDLTCDIRIIYCKGTERSRLIEIDEEHTKTLEVPGGISIPNVSRDIKCVQGTEEHFSTGVLDFEQMAGYFNEVLSLSGKTASGVFNAVFNFSGSWNSDALATKSLAVDGWSIILYSLSLTRAPLTLIHEVKAAVPYTWDPAALASFIEKYGTHIVTSVSVGGKDAIYVKQHQSSTLTSTDVELHLKELRSIRFSPYGGHISFLGNEKVADQMLFSTQQILPQPCNSNGSSSFAGKEDITVIYRRRGGNDLVQGHDEWKKTVPTNPDVVTMTFVPITSLLENGPRSDHLSRAILVYLEYKPPIEELQYFLAFQVARVWAPVQNELGPPRREPVCPALQFSLMGPKLYISTEQVSVGRRPVTGLRLSLEGRNCNRLAVHVQHLTSLPKVLQPHWDAYIAIGAPKWHGPEEQDSRWFEPVLWRNFSHISTAPVEFNETWIGDASGAFVVTGAQLGVWDFGLKSVLYLRLLYSKVPGCTIRRSVWDHTPVSLNQNLKMDSSKVLNTVPTATSQTPKLLKFVDTTEMSRGAQDMPGHWLVTGAKLGVDKSKIFLRVRYSLLNY

SEQ ID NO: 892 - protein, 345 aa, Equisetum
MAEDEPSCTLATSVIQALGQGFDITSDIRLSYCKGSRLVQIDTEQTSDLVLPGVTASIPQVPTEIKCLPGRIMRHGTGVLDFEKMAQRFNKALSVNGKIPSGLFNAMFSFSGSWRADAHVTKSLALDGWFIMLYNLKLAQSSFKLRGEIKREVPSTWDPAALASFIERHGTHIVTSVTVGGKDAIYVKQHQSSSLTSMEIESYLKELGDRRFLARSKHSAFEMKEKGAGQSFPPPAQSLLPTSASDSSSSLTGKEDVTVIYRRRGGDDLVQNHEEWKYTIFSNPDVISMTFIPIASLLEGCPGKEHLIRAIDIYLECIFFFQCLKNQDIIPGVGTMIVYIVVKFG

SEQ ID NO: 893 - protein, 281 aa, Tupidanthus calyptratus
MSPLILGFFIAREFLGDSTVFSLSSTKDPSFMEPRKNMSSDALNTTLWNSIQALGRGFDVTSDIRLLYCKGIPGSRLVQINDRDAKDLRVSDEFVVPNVSVDIECSKGEKITETTPVCSFHEMAIYFNEKSEISGHVPLGSFNAMFNLTGSWQLDAATTKSLAMIGSVIPLYKVELANLDLVLNEEVKRAVPYSWDPASLASFIENYGTHIVTSATVGGRDVVYIRQHQSSPLSVSDIENYVKDIADQRYSGSRSNPSAAPLKYKDKVSFPLKKYLKIDSP

SEQ ID NO: 894 - protein, 572 aa, Asplenium nidus var plicatum
MADEDSSLRGAFATAVNAVQALGRGFDVTCDIRLLYCKGTPGSRLVVIDDDHTADLKLSDGLVIPNVSMDIRARLEKPYRPSLGVQDFHKMSEEFNKKLFIGGDIPSGMFNAMFNFSGSWQVDSSMTKSLAIDGLVLPLYSVHLRSPFILCEEVKNAVPNTWDPAALASFIEKYGTHIIRSVEIGGKDIIYVKQHPSSTLTKHEVESHLKKLVESRFQGRESDVIRRKDKENTDSSSSLTGKEDITVIYRRRGGDDLVQDHVEWKKTVNFNPDILSMAFFPIVLLLDAGSGREHLNRAIEAHLKYKPPLEELHYFLEFQLTRAWAPLVNPAGPPRKEPVCPALQFSLMGPKLFINTSQVSVGRKPVTGLRLSLEGSKLNRLAVHVQHLAVLPKILQPHWDAYVAIGAPKWHGPEEQDSRWFEPVLWKNFAHVSTAPVEFSETWFGDASGAFIVTGAQLGVWDFGLKSVLHLKLLYSKVPGCTIRRSVWDHAPIGGQQQGKAKGASSASPAAPDAAAAAAATQATQKLSKFVDTSEMARGPQDLPGHWLVTGAKLCVGKSKIFLRVKYSLLNY

SEQ ID NO: 895 - protein, 358 aa, Waldsteinia ternata
MATRSSSSEALRTTLSNTIQALGRGFDVTSDIRLLYCKGAPGSRLVNLNETEAKDLAVSDGVVVPNVPADIQCSSGSRNTERVSVCSFHEMAEYFNKKSGISSRIPLGSFNAMFNFTGSWKVDASATKSLALVGYCIPLYKVDLGAENLVLHDEIKRAVPYTWDPAALASFIENYGTHIVTSATIGGRDVVYIRQHHSSPLSTSDIQSYVKDIGDDRFGDTKGQSSAGPLKYKDKDVTVIFRRRGGDDLEQSHSRWAETVQLAPDVINMTFTPIVSLLEGVPGIKHLSRAIELYLECKTQSRNSSFLIIVSVSLKNKLKTRSDIEVYSLQFYRFKSYKIPKFLLDKLTDSFIYDPIRT

SEQ ID NO: 896 - protein, 587 aa, Microsorum punctatum (Serratum)
MANEDASRGARATALNAVQAIGRGFDVTCDIRLLYCKGTPGSRLVVIDDDHTADLEVADDLVIQNVSKDIKARIEKPARAYQGVQDFDQMSELFNKKLSIDGKVPSGMFNAMFNFSGSWQVDSSITKSLAIDGMHIPLYSVHLRPPFILCEEVKRAVPSTWDPPALASFIEKYGTHIIRSVEVGGKDIIYMKQHSSSTLSKAEVETHLKKLVETRFQDLDNQLNDEELTSSNPQKYRSQLVHADSSSSLTGKEDITVIYRRRGGDDLVQDPREWKKTVKSNPDILTMSFFPIVLLMDAGPNREHLIRAIDAHLKYKPPLEELQYFLEFQVTRAWAPVANQVGVPRKEPVCPSLQFSLMGPKLYISTDQVSVGRKPVTGLRLCLEGSKLNRLAVHVEHLTVLPKILQPHWDAYVAIGAPKWHGPEEQDSRWFEPVLWKNFAHVSTAPVEFSETWFGDASGAYIVTGAQLGVWDFGVKSVLHLKLLYSKVPGCTIRRSVWDHTPIGQQVSKAKKGASSAAAAAAGVAAAAIGAATSTTQTMQKLSKLIDTTEMSRGPQDLPGHWLVTGAKLCVEKGNIFLRVKYSLLNY

SEQ ID NO: 897 - protein, 449 aa, Phormium (Lancer Terra Cotta)
MEKNKNEKAAALIATLWNSVQALGRGFDVTADTRLLYCKGAAGSRFVQIGEGQIRDFVVTEGGAVLRDVPVDVEISRERRVRDTTRVCSFREMAEYFNKKSGLFETVPLGSFNSMFSLTGSWKIDAAATKTLAMDGYFIPLFKVKLTDPALILREDIKRAVPRSWDPPSLANFIENFGTHIITSVKIGGKDVVYIKQHHSSLLSTSDIEKYLTEIGDQRFSDLENQFADALLLNNRDGRPQLSSVPHLSGKEDVTVIFRRRGGDDLVQNHAEWAATVSSAPDVINMTFIPIVSLLEGLPGIQYLARAIDLYLDYKPPIEELQYFLEFQIQRVWPPAPSNIPGHQRKEPVCPFLQFSLMGPKLYISSEQISVGRKPVTGLRLCLEGIKQDRLAIHLQHLASLPKILRPHWDSHIAIGAPKWQGPEEQDSRWFEPIKWKNFAHLLMSVRHQ

SEQ ID NO: 898 - protein, 553 aa, Asplenium nidus var plicatum
MTDEDASSRGAFVTAVNAVQALGRGFDVTCDIRLLYCKGTPGSRLVVIDDDHNTDLRVSDGVVIPNVSPDIRARLEKPYRPSLGVQDFHKMSEEFNKKLFIGGDIPSGMFNAMFNFSGSWQVDSSMTKSLAIDGLVLPLYSVHLRSPFILCEEVKNAVPNTWDPAALASFIEKYGTHIIRSVEIGGKDIIYVKQHPSSTLTKHEVESHLKKLVESRFQAMESDVIRRKDKENSESSSSLTGKEDITVIYRRRGGDDLVQDHVEWKKTVNSNPDILSMAFFPIVLLLDAGSGREHLNRAIEAHLKYKPPLEELHYFLEFHVARAWAPLANPVGPPRKEPICPALQFSLMGPKLFINTSQVSVGRKPVTGLRLSLEGSKLNRLAVHVQHLAVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHTPTGQQQSKGTKGTSSASPAAGTAAALVALLLLLLVALLLLLLVACCCCCCCDTGHPETLQVC

SEQ ID NO: 899 - protein, 556 aa, Waldsteinia ternata
MATRSSSSEALRTTLSNTIQALGRGFDVTSDIRLLYCKGAPGSRLVNLNETEAKDLAVSDGVVVPNVPADIQCSSGSRNTERVSVCSFHEMAEYFNKKSGISSRIPLGSFNAMFNFTGSWKVDASATKSLALVGYCIPLYKVDLGAENLVLHDEIKRAVPYTWDPAALASFIENYGTHIVTSATIGGRDVVYIRQHHSSPLSTSDIQSYVKDIGDDRFGDTKGQSSAGPLKYKDKDVTVIFRRRGGDDLEQSHSRWAETVQLAPDVINMTFTPIVSLLEGVPGIKHLSRAIELYLEYKPPIEDLQYFLDFQIAQAWAPEQNNLQRKGPVCSSLQFSLMGPKLYISPDQVTVGRKPVTGLRLNLEGDKQNRRLAIHLQHLVSLPKILQPHWDAHMAIGAPRWQGPEEQDSRWFEPIKWKNFSHVSTAPIEHVETSIGDLSGVHIVTGAQLGVWDFGAKNVLHLKLLFSKVPGCTIRRSVWDHSPATPSTQRSDGSSSSHSSNRNSDDKKDKLAKLVDLTEMSKGPHDSPGHWLVTGAKLGVDKGKIVLRVKYSLLNY

SEQ ID NO: 900 - protein, 316 aa, Equisetum
MAEDEPSCTLATSVIQALGQGFDITSDIRLSYCKGSRLVQIDTEQTSDLVLPGVTASIPQVPTEIKCLPGRIMRHGTGVLDFEKMAQRFNKALSVNGKIPSGLFNAMFSFSGSWRADAHVTKSLALDGWFIMLYNLKLAQSSFKLRGEIKREVPSTWDPAALASFIERHGTHIVTSVTVGGKDAIYVKQHQSSSLTSMEIESYLKELGDRRFLARSKHSAFEMKEKGAGQSFPPPAQSLLPTSASDSSSSLTGKEDVTVIYRRRGGDDLVQNHEEWKYTIFSNPDVISMTFIPIASLLEGCPGKEHLIRAIDIYLE

SEQ ID NO: 901 - protein, 276 aa, Hedera helix (Galaxy)
MGENAAALHTAMNSVQALGKGFDVNFDTRLLYCKGVAGSRIVEIDEEHTRDLCLYDGLVVPNVSKDVHNSQTRDLCLYDGLVVPNVSKDVQNSQETIGRDGSGVCNYFEMMEYVNKKANLSENVPLGCFNAAFNFTSCKNIDAAATKTLCLDGFFIPLAKVQLVKSQLALQENVIRAVPASWDPPALASFIENFGTHVIVSVTIGGKDVIYVKQHQSSSLSKVEIKNYVQDIGNQRFSTTENHTTSGLLKYKDKGVDPSLYNSQGVHPQPSTATSP

SEQ ID NO: 902 - protein, 431 aa, Tupidanthus calyptratus
MEENAAALHTAMNSVQALGRGFDVNFDIRLLYCKGVAGSRIVEIDEEHTRDMCLYDGLVVPNVSKDVHNSQETIGRDGSGVCNYFEMVEYINKKANLSENVPVGCFNAAFNFTGCKHIDAAATKTLCLDGFFIPLAKVQLVKSQLVLQENVIRAVPASWDPPALASFIENFGTHVIVSVTIGGKDVIYVKQHQSSSLSKVEIKNYAQDIGNQRFSTTENHTYVKQHQSSPLSKVEIKNYAQDIGNQRFSTTENHTISGLLKYKDKGVDPSLYNSQGVHPQPSTATSLIGNGKEDVTVIFRRRGGDDLEQSHTQWARTVRSSPDVIEMSFFPIIPLLEGVTGKEHLAQAIDLYLEYKPQIEELRYFLEFQVPRIWAPIQDRPPGYQRKEPVCPIFAVQHDGAKALHQPRASFSWAQTRDRVLRSKIADGSSQ

SEQ ID NO: 903 - protein, 598 aa, Polystichum polyblepharum (LW12418)
MLHVTSDFCTARARRAQDWLSLMMTTLPISMFRMVWLSQMFLKTLKQGWRNHFAPLRGRKTLIRCQSCSTRNWVLEERSRQERLMPCSIFQDHGREGAQDFDQMSELFNKKLGIGGKIPSGTFNAMFNFSGSWQVDSSITKSLSVDGVVIPLYSVHLRPPFILREEVKMAVPSTWDPPALASFIEKYGTHIIISVEVGGKDTIYVKQHLSSSLTKSEVDSHVKKLVETRFQGMESGVTQAKDKFQELALTNPQKNRSQLVHDDGSSSLTSKEDITVIYRRRGGDDLVQDHLEWKKTVNTNPDILSMAFFPIVVLLDAGSGREHLNRAIEAHLQYKPPLEELQYFLEFQVTRAWAPVANQVGLPRKEPVCPSLQFSLMGPKLFISTDQVSVGRKPVTGLRLCLEGSKLNRLAVHLQHLTVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHTPIGQQLSKAKKGTSSATAAAAAAATVTQTTQKLSKFVDTTEMARGPQDLPGHWLVTGAKLCVEKSNIFLRVKYSLLNY

SEQ ID NO: 904 - protein, 365 aa, Equisetum
MAEDEPSCTLATSVIQALGQGFDITSDIRLSYCKGSRLVQIDTEQTSDLVLPGVTASIPQVPTEIKCLPGRIMRHGTGVLDFEKMAQRFNKALSVNGKIPSGLFNAMFSFSGSWRADAHVTKSLALDGWFIMLYNLKLAQSSFKLRGEIKREVPSTWDPAALASFIERHGTHIVTSVTVGGKDAIYVKQHQSSSLTSMEIESYLKELGDRRFLARSKHSAFEMKEKGAGQSFPPPAQSLLPTSASDSSSSLTGKEDVTVIYRRRGGDDLVQNHEEWKYTIFSNPDVISMTFIPIASLLEGCPGKEHLIRAIDIYLECISRGSSKDVFAMKEPTCESYHCNIIYQVYIHDNTKELMHRKEMFCNKS

SEQ ID NO: 905 - protein, 368 aa, Ophioglossum pendulum
MEEDDNDSALKTSIVVNALQTLGRGFDLTCDIRIIYCKGTERSRLIEIDEEHTKTLEVPGGISIPNVSRDIKCVQGTEEHFSTGVLDFEQMAGYFNEVLSLSGKTASGVFNAVFNFSGSWNSDALATKSLAVDGWSIILYTLSLTRVPLTLIHEVKVAAPYTWDPAVLASFIERYGTHIVTSVSIGGKDVIYVKQHQSSTLTPTDVELHLKELRSVRFSPFGGHISFMMNEKVADQMLFSTQQIRPQPYNSDCSSSFTGKEDITVIYRRRGGNDLVKGHDEWKKTVPTNPDVVTMTFIPITSLLEDGPCKDHLNRAILVYLEYKPPIEELQYFLAFQVARVWAPWAPVQNELGPLQGGSQFVLLCSSV

SEQ ID NO: 906 - protein, 331 aa, Tupidanthus calyptratus
MSPLILGFFIAREFLGDSTVFSLSSTKDPSFMEPRKNMSSDALNTTLWNSIQALGRGFDVTSDIRLLYCKGIPGSRLVQINDRDAKDLRVSDEFVVPNVSVDIECSKGEKITETTPVCSFHEMAIYFNEKSEISGHVPLGSFNAMFNLTGSWQLDAATTKSLAMIGSVIPLYKVELANLDLVLNEEVKRAVPYSWDPASLASFIENYGTHIVTSATVGGRDVVYIRQHQSSPLSVSDIENYVKDIADQRYSGSRSNPSAAPLKYKDKDVTVIFRRRGGDDLEQSHVRWAETVQTSPDVINMTFIPIVSLLEGVPGIKHLACAIELYLECKI

SEQ ID NO: 907 - protein, 586 aa, Equisetum arvense
MAEDEDPVVEPCQSLAASSIQAMGRGFDLTCDIRLSYCKGVSPLVHLDQQNKKDLRLPGGISIPDAPAEIQCLHGRTSHHGTNTLNFDQMSERFNKALSIEGKIPSGLFNAMFSFSGSWRADASTTKSLALDGWFSTLYNLKLAKHSLKLHDEVKREVPSTWDPEALASFIEKHGTHIVTSVTVGGKDTIYVKQHQSSSLTSIEIESYLKELGDRRFLAGSSNPALDLNDKAAGQSSPLTGPNLVQTLGSDGPSSLTGKEDVTVIYRRRGGDDLVQNHEEWKDTIKSNPDVISMTFIPITSLLEGCPGKEHLIRAIDVYLEYKPPIEELQYFLEFQVAKAWAPVQNEGRLPRKEPVCPSLQFSLMGPKLYINTEQVSVGRRPVIGLRLCLEGSKVNRLSVHVLHLVALPKLLQPHWDSYVAIGPPKWHGPEEQDSRWFEPIQWKNFSHVSTAPIEYSEGWMGDVSGAHVVTGAQLGVWDFGPKSVLHLRLLYSKVPGCTIRRSIWDYNPNPSSFNPSTNPSKASKEVNASSSSNAPQVNKLTKFVDTEEMVKGPQDMPGHWLVTGAKLGVEKSKIFLRVKYSLLNY

SEQ ID NO: 908 - protein, 284 aa, Tupidanthus calyptratus
MSPLILGFFIAREFLGDSTVFSLSSTKDPSFMEPRKNMSSDALNTTLWNSIQALGRGFDVTSDIRLLYCKGIPGSRLVQINDRDAKDLRVSDEFVVPNVSVDIECSKGEKITETTPVCSFHEMAIYFNEKSEISGHVPLGSFNAMFNLTGSWQLDAATTKSLAMIGSVIPLYKVELANLDLVLNEEVKRAVPYSWDPASLASFIENYGTHIVTSATVGGRDVVYIRQHQSSPLSVSDIENYVKDIADQRYSGSRSNPSAAPLKYKDKDSLYQAASIITFISIRH

SEQ ID NO: 909 - protein, 537 aa, Asplenium nidus var plicatum
MTDEDASSRGAFVTAVNAVQALGRGFDVTCDIRLLYCKGTPGSRLVVIDDDHNTDLRVSDGVVIPNVSPDIRARLEKPYRPSLGVQDFHKMSEEFNKKLFIGGDIPSGMFNAMFNFSGSWQVDSSMTKSLAIDGLVLPLYSVHLRSPFILCEEVKNAVPNTWDPAALASFIEKYGTHIIRSVEIGGKDIIYVKQHPSSTLTKHEVESHLKKLVESRFQGRESDVIRRKDKENTDSSSSLTGKEDITVIYRRRGGDDLVQDHVEWKKTVNFNPDILSMAFFPIVLLLDAGSGREHLNRAIEAHLKYKPPLEELHYFLEFQLTRAWAPLVNPAGPPRKEPVCPALQFSLMGPKLFINTSQVSVGRKPVTGLRLSLEGSKLNRLAVHVQHLAVLPKILQPHWDAYVAIGAPKWHGPEEQDSRWFEPVLWKNFAHVSTAPVEFSETWFGDASGAYIVTGAQLGVWDFGLKSVLHLKLLYSKVPGCTIRRSVWDHTPTGQQQSKGTKGTSSASPAAGTAAALVACCCCCCCDTGHPETLQVC

SEQ ID NO: 910 - protein, 368 aa, Tupidanthus calyptratus
MEPRKNMSSDALNTTLWNSIQALGRGFDVTSDIRLLYCKGIPGSRLVQINDGVTKDLAVSDGFVVPNVSVDIESSRGEEVTETTAVCSFHEMAIYFNEKSEISGHVPLGSFNAMFNLTGSWQLDAATTKSLAMIGSVIPLYKVELANLDLVLNEEVKRAVPYSWDPASLASFIENYGTHIVTSATVGGRDVVYIRQHQSSPLSVSDIENYVKDIADQRYSESRSHPSAAPLKYKDKDVTVIFRRRGGDDLEQSHIRWAETVQTSPDVINMTFIPIVSLLEGVPGIKHLARAIELYLEYKPPIEDLQYFLEFQIARVWAPEQSNIQRKDPVCPSLHFSLMGPKLYISPDQVPCLVFNTLLLNCCYEPMV

SEQ ID NO: 911 - protein, 584 aa, Tupidanthus calyptratus
MEPRKNMSSDALNTTLWNSIQALGRGFDVTSDIRLLYCKGIPGSRLVQINDRDAKDLRVSDEFVVPNVSVDIECSKGEKITETTPVCSFHEMAIYFNEKSEISGHVPLGSFNAMFNLTGSWQLDAATTKSLAMIGSVIPLYKVELANLDLVLNEEVKRAVPYSWDPASLASFIENYGTHIVTSATVGGRDVVYIRQHQSSPLSVSDIENYVKDIADQRYSESRSHPSAAPLKYKDKDVTVIFRRRGGDDLEQSHIRWAETVQTSPDVINMTFIPIVSLLEGVPGIKHLARAIELYLEYKPPIEDLQYFLEFQIARVWAPEQSNIQRKDPVCPSLHFSLMGPKLYISPDQVTVGRKPVTGLRLTLEGTKQNRLAVTVGRKPVTGLRLTLEGTKQNRLAIHLQHLVSLPKILQPHWDAHMAIGAPKWQGPEEQDSRWFEPIKWKNFSHVSTAPIEHTETCIGDLSGVYIVTGAQFGVWDFGASKSVLHLKLLFSKVPGCTIRRTVWDHSPSNVSGVQRSNGASTSLLHERTTDSSGHIGKLAKIVDMTEMSKGPQDIPGHWLVTGAKLGVDKGKIVLRIKYSLLNY

SEQ ID NO: 912 - protein, 376 aa, Verbascum chaixii (Vill)
MALPSENALITTLGNSIQALGRGFDVTSDIRLLYCKGAPGSRLVHINEEQTRNLEISGSYAIPNVSVDIECSQGQSFNNKTPVWSFHEMAKYFNEKSGLPGNIPLGCFNAMFNFSGSRQLDAAATKSLAMVGYIIPLFTVKLAKPDLILHDQIKRAVPYSWDPASLASFIENYGTHIVTSATIGGRDVVYIRQHQSSPLSTSDIENYVKDIGDQRFSDSKGNSSAGSLKYKDKDVTVIFRRRGGDDLEQSYEKWAKSVEGAPDVISMTFTPIVSLLEGVPGIKHLARAIELYLEYKPPIEDLQYFLDFQISRAWAPEQNNNLQRKEPVCSSLQFSLMGAKLYISPDQVTVGRKPVTGLKLSLDYISPDQVYINIIP

SEQ ID NO: 913 - protein, 358 aa, Tupidanthus calyptratus
MEPRKNMSSDALNTTLWNSIQALGRGFDVTSDIRLLYCKGIPGSRLVQINDRDAKDLRVSDEFVVPNVSVDIECSKGEKITETTPVCSFHEMAIYFNEKSEISGHVPLGSFNAMFNLTGSWQLDAATTKSLAMIGSVIPLYKVELANLDLVLNEEVKRAVPYSWDPASLASFIENYGTHIVTSATVGGRDVVYIRQHQSSPLSVSDIENYVKDIADQRYSGSRSNPSAAPLKYKDKDVTVIFRRRGGDDLEQSHVRWAETVQTSPDVINMTFIPIVSLLEGVPGIKHLACAIELYLEYKPPIEDLQYFLEFQIARVWAPEQSNIQRKDPVCPSLHFSLMGPKLYISPDQVSSLGPRAE

SEQ ID NO: 914 - protein, 495 aa, Ophioglossum pendulum
MEDDDSALKVSIAVNALQTLGRGFDLTCDIRIIYCKGTEGSRLLEIDEEHTKNLELPGGISIPDVSRDIKCVQGTEKHFSTGVLHFEQMAGYFNEVLSLSGKTASGVFNAVFNFSGSWNSDALATKSLAVDGWSIILYSLSLTRAPLTLIHEVKAAVPYTWDPAALASFIEKYGTHIVTSVSVGGKDAIYVKQHQSSTLTSTDVELHLKELRSIRFSPYGGHISFLGNEKVADQMLFSTQQILPQPCNSNGSSSFAGKEDITVIYRRRGGNDLVKGHDEWKKTVPTNPDVVTMTFIPITSLLEDGPCKDHLNRAILVYLEYKPPIEELQYFLAFQVARVWAPVQNELGPPRREPVCPALQFSLMGPKLYISTEQVSVGRRPVTGLRLSLEGRNCNRLAVHVQHLTSLPKVLQPHWDAYIAIGAPKWHGPEEQDSRWFEPVLWRNFSHISTAPVEFNETWIGDASGAFVVTGAQLGVWDFGLKRLFPHKHCTCGVQ

SEQ ID NO: 915 - protein, 277 aa, Tupidanthus calyptratus
MAIYFNEKSEISGDVPLGSFNAMFNLTGSWQLDAATTKSLAMIGSVIPLYKVELANLDLVLNEEVKRAVPYSWDPASLASFIENYGTHIVTSATVGGRDVVYIRQHQSSPLSVSDIENYVKDIADQRYSESRSHPSAAPLKYKDKDVTVIFRRRGGDDLEQSHIRWAETVQTSPDVINMTFIPIVSLLEGVPGIKHLACAIELYLEYKPPIEDLQYFLEFQIARVWAPEQSNIQRKDPVCPSLHFSLMGPKLYISPDQVPCLVFNTLLLNCCYEPMV

SEQ ID NO: 916 - protein, 355 aa, Verbascum chaixii (Vill)
MASMGSENALITTLCNSIQALGRGFDVTSDIRLLYCKGAPGSRLVHINEEQTRNLEISGSYAIPNVSVDIECSQGQSFNNKTPVWSFHEMAKYFNEKSGLPGNIPLGCFNAMFNFSGSRQLDAAATKSLAMVGYIIPLFTVKLAKPDLILHDQIKRAVPYSWDPASLASFIENYGTHIVTSATIGGRDVVYIRQHQSSPLSTSDIENYVKDIGDQRFSDSKGNSSAGSLKYKDKDVTVIFRRRGGDDLEQSYEKWAKSVEGAPDVISMTFTPIVSLLEGVPGIKHLARAIELYLEYKPPIEDLQYFLDFQISRAWAPEQNNNLQRKEPVCSSLQFSLMGAKLYISPDQVYINIIP

SEQ ID NO: 917 - protein, 564 aa, Prostanthera rotundifolia
MASPPTKNFSSLTVSENALTTTLCNSIQALGRGFDVTSDIRLLYCKGAPGSRLVHIDEEQNRNLEISESCVIPNVSVDIECCGGQSSNEKTPVWSFHEMAKYFNGKSGLPGQVPLGGFNAMFNFSGSWQLDAAATKSLAMVGYIIPLFSVKLVKADLILRDEIKRAVPYSWDPASLASFIENYGTHIVTSATIGGRDVVYVRQHQSSPLSASDIENYVKDIGDQRFSDSKVNTNAGSLKYKDKDVTVIFRRRGGDDLEQSYTKWATTVERAPDVINMTFTPIISLLEGVAGIKHLARAIELYLEYKPPIEDLQYFLDFQISRVWAPEQNNLQRKEPVCPSLQFSLMGSKLYISPDQVTVGRKPVTGLKLSLEGIKQNRLTINLQHLVSLPKILQPHWDAHIAIGAPKWQGPEEQDSRWFEPIKWKNFSHVSTAPIEFTDTCIGDLSGVHIVTGAQLGVWDFGAKSVLHLKLLFSKVPGCTIRRSVWDHSPSNLSAPQKPDGSSSSLSEKGDGSSQIGKLTKIVDMTEMSKGPQDMPGHWLVTGAKLGVDKGRIVLRVKYSLLNY

SEQ ID NO: 918 - protein, 331 aa, Tupidanthus calyptratus
MSPLILGFFIAREFLGDSTVFSLSSTKDPSFMEPRKNMSSDALNTTLWNSIQALGRGFDVTSDIRLLYCKGIPGSRLVQINDGVTKDLAVSDGFVVPNVSVDIESSRGEEVTETTAVCSFHEMAIYFNEKSEISGHVPLGSFNAMFNLTGSWQLDAATTKSLAMIGSVIPLYKVELANLDLVLNEEVKRAVPYSWDPASLASFIENYGTHIVTSATVGGRDVVYIRQHQSSPLSVSDIENYVKDIADQRYSGSRSNPSAAPLKYKDKDVTVIFRRRGGDDLEQSHVRWAETVQTSPDVINMTFIPIVSLLEGVPGIKHLACAIELYLECKI

SEQ ID NO: 919 - protein, 581 aa, Ophioglossum pendulum
MEDDDSALKVSIAVNALQTLGRGFDLTCDIRIIYCKGTEGSRLLEIDEEHTKNLELPGGISIPDVSRDIKCVQGTEKHFSTGVLHFEQMAGYFNEVLSLSGKTASGVFNAVFNFSGSWNSDALATKSLAVDGWSIILYSLSLTRAPLTLIHEVKAAVPYTWDPAALASFIEKYGTHIVTSVSVGGKDAIYVKQHQSSTLTSTDVELHLKELRSIRFSPYGGHISFLGNEKVADQMLFSTQQILPQPCNSNGSSSFAGKEDITVIYRRRGGNDLVQGHDEWKKTVPTNPDVVTMTFVPITSLLENGPRSDHLSRAILVYLEYKPPIEELQYFLAFQVARVWAPVQNELGPPRREPVCPALQFSLMGPKLYISTEQVSVGRRPVTGLRLSLEGRNCNRLAVHVQHLTSLPKVLQPHWDAYIAIGAPKWHGPEEQDSRWFEPVLWRSFSHISTAPVEFSETWVGDASGAFIVTGAQLGVWDFGLKSVLYLRLLYSKVPGCTIRRSVWDHTPVSLNQNLKMDSSKVLNTVPTATSQTPKLLKFVDTTEMSRGAQDMPGHWLVTGAKLGVDKSKIFLRVRYSLLNY

SEQ ID NO: 920 - protein, 550 aa, Equisetum
MASWELNIIYGSSVPWVWESIGGGIDTIHYMIKSWTDQEVDHCGLPCSKIRAGLYQMAQRFNKALSVNGKIPSGLFNAMFSFSGSWRADAHVTKSLALDGWFIMLYNLKLAQSSFKLRGEIKREVPSTWDPAALASFIERHGTHIVTSVTVGGKDAIYVKQHQSSSLTSMEIESYLKELGDRRFLARSKHSAFEMKEKGAGQSFPPPAQSLLPTSASDSSSSLTGKEDVTVIYRRRGGDDLVQNHEEWKYTIFSNPDVISMTFIPIASLLEGCPGKEHLIRAIDIYLEYKPPIEELQYFLEFQVAKVWAPVQNEGRLPRKEPVCPSLQFSLMGPKLYINTEQVSVGRRPVIGLRLCLEGSKVNRLSVHVLHLVALPKLLQPHWDSYVAIGPPKWHGPEEQDSRWFEPIQWKNFSHVSTAPIEYSEGWMGDDSGAHVVTGAQLGVWDFGPKSVLFLRLLYSKVPRCTIRRSVWDHNPASYHDSDASKDIINTSPISSSGALQVNKLVKFVDTEEMTRGPHDMPGHWLVTGAKLGVEKSRIFLRAKYSLLNY

SEQ ID NO: 921 - protein, 397 aa, Selaginella victoriae (LW10887)
MERGMAQGKIGAQITASEAVQALGKGFDVTLDLRLASCKGSFGRLVELDERNLQDLFVQERVVVPNVSKDIKCEKGEFTHFRSEVLTFHQMSERFNQGLSITGKMPLGLFNSMYSFNGTWQSDASDTKSLALDGWFITLYNLQISRSPLVLRDEVKKAVPTSWDPAALAKFIDTYGTHIITSIKVGGKDVVYVRQHQSSPLSPTELQKFIKRIADQKFADYNGVASDSNNMKEKVPTPDLLSHAHRIQLENAFTSSSFTAKEDVEIIFRRRGGDSLLKNHNDWLKTVADAPDVISMTFVPITALLNGVLGSGFLSHAVNLYLRHKPPIEDLQYFLDFQIPRQWSPGFDLPLGPQRKEPVCPAMQFSLMGPKLYVSTTQVCFISLKVLNASSLVLFTR

SEQ ID NO: 922 - protein, 603 aa, Huperzia phlegmaria
MDKKAVSNSTVEAKALEAVGALGRGYDVTLDLKLSYCKGSPESCLIQLDKQNLHDIVVPGGFTLFNISKDITCDKGERTRFRSDVLTFHEMSERFNQGLSINARIPLGLFNSMFNFRGPWHIDAQATKSLSLDGWFVTLYKMQIAKTPLVLCDEVKQAVPSSWDAAALANFIVKYGTHIVLSVKMGGKDAIYIRQQASSHLSPLEVQKYLKKIGDQKFREFKEPKEILNKEVTSAPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQNSRWFEPVQWKGFSHVTTAPVELEANATDTAFAYVVIGAQLQVWELDSKKVLFLRLLFLKIHGCSIRRSAWDHMPTLSQKSGLLSQLGLSTSMSSNQHAISTPFVQNSAVFPGGPPAPAPNAKLLKFVNITEMTKGAQDLPGHWLVTGAKLDVENGKISLGVKYSLLHY

SEQ ID NO: 923 - protein, 463 aa, Huperzia carriata (Philippines)
MQITTTSLVLRDEVKQAVPSTWDAAALANFIEKYGTHIVLSVKMGGKDVIYIRQEAQSQLSPFEIQKNLKNIGDLKFHGSRESSYTLNKEVISASTSKNFVEHLPVSNTYDSISFVSQKDIEIIKQRRGGDKFVEAHEDWVTTISSAPEVISMTFVPITSLLSGVLGSGFLSHAINLYMRYKPPIEEIQHFLEFQIPRQWTPGYDLPLGPPRKEPLGPALQFSFLGPKLRISTNQVTVGHKPVTGLRLCLGGKKLNRLSLHLQHLATVPKNLQAYWNTSSSNEAPVWKEPDEKNDRWFEPVQWKGFSHVTTIPMEIEPHSKGAACAFIVTGAQLQVWELETKKVLFLRVLFSKIHGCSIRRSIWDHVASSFPQKPALFSQLGLSTSMSSNQQAMPTPFSLNSAVFPGGPPAPVPNAKLLKFVNTTEMTKGAKDLPGHWLVTGAKLDVEDGKISLGVKYSLLHY

SEQ ID NO: 924 - protein, 609 aa, Selaginella victoriae (LW10887)
MERGMAQGKIGAQITASEAVQALGKGFDVTLDLRLASCKGSFGRLVELDERNLQDLFVQERVVVPNVSKDIKCEKGEFTHFRSEVLTFHQMSERFNQGLSITGKMPLGLFNSMYSFNGTWQSDASDTKSLALDGWFITLYNLQISRSPLVLRDEVKKAVPTSWDPAALAKFIDTYGTHIITSIKVGGKDVVYVRQHQSSPLSPTELQKFIKRIADQKFADYNGVASDSNNMKEKVPTPDLLSHAHRIQLENAFTSSSFTAKEDVEIIFRRRGGDSLLKNHNDWLKTVADAPDVISMTFVPITALLNGVLGSGFLSHAVNLYLRHKPPIEDLQYFLDFQIPRQWSPGFDLPLGPQRKEPVCPAMQFSLMGPKLYVSTTQVTIGRRPVTGLRLFLEGKKCNRLAIHLQHLSSLPKILQPHWESTIPIGAPVWKEPEEQDSKWFEPVQWKSFSHVSTAPVQYMEEQYIGGETSGAYIVTGAQLGVWDFGMKKVLFLRLLFSKVPGCSIRKTVWDHSPASSQKSGLFSQLGLSSTFSGARKAKPAPAIVLNSAVYPGGPPVPVPSPKLLKYVDIAEMTKGAHDIPGHWLVTGAKLDVDRGRIALRLKYSLLHY

SEQ ID NO: 925 - protein, 419 aa, Platycerium bifurcatum
MGGKDAIYIRQQASSHLSPLEVQKYLKKIGDQKFRESKEPKEILNKEVTSVPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQNSRWFEPVQWKGFSHVTTAPVELEANATDTAFAYVVIGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNITEMTKGAQDLPGHWLVTGAKLDVENGKISLGVKYSLLHY

SEQ ID NO: 926 - protein, 514 aa, Huperzia carriata (Philippines)
MSERFNQGLSINARIPLGLFNSMFNYNGPWHVDAQTTKSLALDGWFITLYKMQITTTSLVLRDEVKQAVPSTWDAAALANFIEKYGTHIVLSVKMGGKDVIYIRQEAQSQLSPFEIQKNLKNIGDLKFHGSRESSYTLNKEVISASTSKNFVEHLPVSNTYDSISFVSQKDIEIIKQRRGGDKFVEAHEDWVTTISSAPEVISMTFVPITSLLSGVLGSGFLSHAINLYMRYKPPIEEIQHFLEFQIPRQWTPGYDLPLGPPRKEPLGPALQFSFLGPKLRISTNQVTVGHKPVTGLRLCLGGKKLNRLSLHLQHLATVPKNLQAYWNTSSSNEAPVWKEPDEKNDRWFEPVQWKGFSHVTTIPMEIEPHSKGAACAFIVTGAQLQVWELETKKVLFLRVLFSKIHGCSIRRSIWDHVASSFPQKPALFSQLGLSTSMSSNQQAMPTPFSLNSAVFPGGPPAPVPNAKLLKFVNTTEMTKGAKDLPGHWLVTGAKLDVEDGKISLGVKYSLLHY

SEQ ID NO: 927 - protein, 604 aa, Huperzia tetratoides
MDKRTVVYPTAREKGLEAVRALGRGYDVTLDLKLGYCKGSRQSCLIQLDNENVHDIVVPGGFTLCNVSKDISCDKGERTRFRSDVLSFHEMSERFNQGLSINARIPLGLFNSMFNFRGPWHIDAQATKSLSLDGWFVTLYKMQIAKTSLVLCDEVKQAVPSSWDAAALASFIVKYGTHIVLSVKMGGKDAIYIRQQASSHLSPLEVQKYLKKIGDQRFRESREPKDILNKEVRSAPTTMNLAQHLQFAKTYHSISFMSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNQVSVGLRPVTGLRLNLGGKKFNRLSLHLQHLATLPKTLQPYWKTSLSSEARLWKEPEEQNSRWFEPVQWKGFSHVTTAPVELEPSATDTAFAYVVIGAQLQVWDLDSKKVLFLRLLFLKIHGCSVRRSAWDHMPSLSQKSGLLSQLGLSSTSMPSNKHAAPTPFVQNSAVFPGGPPAPAPNARLLKFVNITEMTKGAQDLPGHWLVTGAKLDVENGKISLAVKYSLLHY

SEQ ID NO: 928 - protein, 603 aa, Huperzia nummulariifolia
MDKKAVSNSTVEAKALEAVGALGRGYDVTLDLKLSYCKGSPESCLIQLDKQHLHDIVVPGGFTLFNISKDITCDKGERTRFRSDVLSFNEMSERFNQGISINGRMPLGLFNSMFNFRGPWHIDAQATKSLSLDGWFVTLYKMQIAKTPLVLCEEVKQAVPSSWDAAALANFIVKYGTHIVLSVKMGGKDAIYIRQQASSHLSPLEVQKYLKKIGDQKFRESKEPKEILNKEVTSVPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQHFLEFQIPRQWTPGYDLPLGPQRKEPLGPALQFSFLGPKLHISTNEVSVGLRPVTGLRLYLGGKKFNRLSLHLQHLATLPKTLQPYWKTSLSGEARLWKEPEEQNSRWFEPVQWKGFSHVTTAPVELEPCAMDTAFAYVVIGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNITEMTKGAQDLPGHWLVTGAKLDVENGKISLGVKYSLLHY

SEQ ID NO: 929 - protein, 604 aa, Huperzia squarrosa
MDKRAVLNSTVQSKAIEAVGALGRGYDVTLDLKLGYCKGSPESCLIELDKQHFHDIVVPGDFTLLNVSKDITCDKGERTRFRSDVLSFHEMSERFNQGTSINGRMPLGLFNSMFNFRGPWHIDAQATKSLSLDGWFVTLYKMQVSRTSLVLCDEVKQAVPSSWDAAALASFIEKYGTHIVLSVKMGGKDVIYIRQQASSNLSPLEVQKYLKKIGDQRFRESREPKDIINKDATSAPTSMNLAQHLQIAKTYHSISFVSKKDIEIIKQRRGGSDFVKSHEEWLTTVSSAPEVISMTFVPIASLLNGVAGSGYLSHAINLYIRYKPPIEEIQQFLEFQIPRQWTPGYDLPLGPQRKEPLGPALQFSFLGPKLHISTNQVSVGLRPVTGLRLYLGGKKFNRLSLHLQHLATLPKSLQPYWKTSLSSEARMWKEPEDQSSRWFEPVQWKGFSHVTTAPVELEANATDTAFAYVVIGAQLQVWELDSKKVLFLRLLFLKIHGCSVRRSAWDHMPSLSQKSGLLSQLGLSSTSMSSNKHAASTPFVQNSAVFPGGPPALAPNAKLLKFVNITEMTKGAEDVPGHWLVTGAKLDVENGKISLGVKYSLLHY

SEQ ID NO: 930 - protein, 603 aa, Huperzia squarrosa
MDKRTVVYPTAREKGLEAVRALGRGYDVTLDLKLGYCKGSPQSCLIQLDNQNVHDIVVPGGFTLFNVSKDISCDKGERTRFRSDVLSFHEMSERFNQGTSINGRMPLGLFNSMFNYNGPWHVDAQTTKSLALDGWFITLYKMQITTTSLVLRDEVKQEVPSAWDAAALANFIEKYGTHIVLSVKMGGKDVIYIRQQASSNLSPLEVQKYLKKIGDQRFRESREPTDILNKEVTSAPTTMNLAQHLQFAKTYHSISLTSKKDIEIIMQRRGGNDFVEAHEGWLQTVSSAPEVISMTFVPIASLLNGVAGSGYLSHAINLYIRYKPPIEEIQQFLEFQIPRQWTPGYDLPLGPQRKEPLGPALQFSFLGPKLHISTNQVSVGLRPVTGLRLYLGGKKFNRLSLHLQHLATLPKTLQPYWKTSLSSEARLWKEPEEQNSRWFEPVQWKGFSHVTTAPVELEPCATDTAFAYVVIGAQLQVWELDSKKVLFLRLLFLKIHGCSVRRSAWDHMPSLSQKSGLLSQLGLSTSMSSNQHAVSTPFVQNSAVFPGGPPAPAPNAKLLKFVNITEMTKGAEDVPGHWLVTGAKLDVENGKISLGVKYSLLHY

SEQ ID NO: 931 - protein, 513 aa, Huperzia carriata (Philippines)
MSERFNQGLSINARIPLGLFNSMFNFRGPWHIDAQATKSLSLDGWFVTLYRMQITKTPLVLCDEVKQAVPSSWDAAALANFIVKYGTHIVLSVKMGGKDAIYIRQQASSQLSPLEVQKYLKKIGDQKFRESKEPKEILNKEVTSAPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQSSRWFEPVQWKGFSHVTTAPVELEANATDTAFAYVVIGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNTTEMTKGAKDLPGHWLVTGAKLDVEDGKISLGVKYSLLHY

SEQ ID NO: 932 - protein, 603 aa, Huperzia carinata
MDKRAVLNSTVQSKAIEAVGALGRGYDVTLDLKLGYCKGSPESCLIELDKQHFHDIVVPGDFTLFNVSKDITCDKGERTRFRSDVLNFHEMSERFNQGLSINARIPLGLFNSMFNFRGPWHIDAQATKSLSLDGWFVTLYRMQIAKTPLVLCDEVKQAVPSSWDAAALANFIVKYGTHIVLSVKMGGKDAIYIRQQASSQLSPLEVQKYLKKIGDQKFRESKEPKEILNKEVTSAPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQNSRWFEPVQWKGFSHVTTAPVELEANATDTAFAYVVIGAQLQVWELDSKKVLFLRLLFFKIQGCSIRRSAWDHMPSLSQTGILSQLGLSSTSMSSNKHAMSTPFVQNSAVFPGGPPAPAPNAKLLKFVNITEMTKGAQDLPGHWLVTGAKLDVENGKISLGVKYSLLHY

SEQ ID NO: 933 - protein, 420 aa, Platycerium bifurcatum
MGGKDAIYIRQQASSHLSPLEVQKYLKKIGDQKFRESKEPKEILNKEVTSVPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQHFLEFQIPRQWTPGYDLPLGPPRKEPLGPALQFSFLGPKLHISTNQVAVGHRPVTGLRLCLGGKKFNRLSLHLQHLATVPKNLQPYWNTSSSNEAPVWKEPDEKNDRWFEPVQWKGFAHVATIPMEIEPHSKGTACAYIVTGAQLQVWELETKKVLFLRLLFSKIHGCSIRRSIWDHVASSFPQKPALFSQLGLSTSMSSNQQAMPTPFSLNSAVFPGGPPAPAPNAKLLKFVNTTEMTKGAKDLPGHWLVTGAKLDVENGKISLGVKYSLLHY

SEQ ID NO: 934 - protein, 604 aa, Huperzia carriata (Solomon Islands)
MDKRTVVYPTTREKGLEAVRALGRGYDVTLDLKLGYCKGSPKSCLIQLDNQNVHDIVVPGGFTLFNVSKDISCDKGERTRFRSDVLTFHEMSERFNQGLSINARIPLGLFNSMFNYNGPWHVDAQTTKSLALDGWFITLYKMQITTTSLVLRDEVKQAVPSTWDAAALANFIEKYGTHIVLSVKMGGKDVIYIRQQAQSQLSPFEIQKNLKKIGDLKFQGSRESSYTLNKEVISASTSKNFVQHLPVSNTYDSISFVSQKDIEIIKQRRGGDKFVEAHEDWVTTISSAPEVISMTFVPITSLLSGVLGSGFLSHAINLYMRYKPPIEEMQHFLEFQIPRQWTPGYDLPLGPPRKEPLGPALQFSFLGPKLHISTNQVTVGHRPVTGLRLCLGGKKFNRLSLHLQHLATVPKNLQAYWNTSSSNEAPVWKEPDEKNDRWFEPVQWKGFSHVTTIPMEIEPHSKGAACAFIVTGAQLQVWELETKKVLFLRVLFSKIHGCSIRRSIWDHVASSFPQKPALFSQLGLSTSMSSNQQAMPTPFSLNSAVFPDGPPAPAPNAKLLKFVNTTEMTKGAKDLPGHWLVTGAKLDVENGKISLGVKYSLLHY

SEQ ID NO: 935 - protein, 604 aa, Huperzia carinata
MDKRTVVYPTTREKGLEAVRALGRGYDVTLDLKLGYCKGSPKSCLIQLDNQNVHDIVVPGGFTLFNVSKDISCDKGERTRFRSDVLNFHEMSERFNQGLSINARIPLGLFNSMFNFRGPWHIDAQATKSLSLDGWFVTLYRMQIAKTPLVLCDEVKQAVPSSWDAAALANFIVKYGTHIVLSVKMGGKDAIYIRQQASSQLSPLEVQKYLKKIGDQRFRESREPKDIINKEATSTPTSMNLAQHLQIAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQNSRWFEPVQWKGFSHVTTAPVELEANATDTAFAYVVIGAQLQVWELETKKVLFLRVLFSKIHGCSIRRSIWDHVASSFPQKPALFSQLGLSTSMSSNQQAMPTPFSLNSAVFPDGPPAPAPNAKLLKFVNTTEMTKGAKDLPGHWLVTGAKLDVENGKISLGVKYSLLHY

SEQ ID NO: 936 - protein, 604 aa, Huperzia squarrosa
MDKRTVVYPTAREKGLEAVRALGRGYDVTLDLKLGYCKGSPQSCLIQLDNQNVHDIVVPGGFTLFNVSKDISCDKGERTRFRSDVLSFHEMSERFNQGTSINGRMPLGLFNSMFNFRGPWHIDAQATKSLSLDGWFVTLYKMQVSRTSLVLCDEVKQAVPSSWDAAALASFIEKYGTHIVLSVKMGGKDVIYIRQQASSNLSPLEVQKYLKKIGDQRFRESREPKDIINKDATSAPTSMNLAQHLQIAKTYHSISFVSKKDIEIIKQRRGGSDFVKSHEEWLTTVSSAPEVISMTFVPIASLLNGVAGSGYLSHAINLYIRYKPPIEEIQQFLEFQIPRQWTPGYDLPLGPQRKEPLGPALQFSFLGPKLHISTNQVSVGLRPVTGLRLYLGGKKFNRLSLHLQHLATLPKSLQPYWKTSLSSEARMWKEPEDQSSRWFEPVQWKGFSHVTTAPVELEANATDTAFAYVVIGAQLQVWELDSKKVLFLRLLFLKIHGCSVRRSAWDHMPSLSQKSGLLSQLGLSSTSMSSNKHAASTPFVQNSAVFPGGPPALAPNAKLLKFVNITEMTKGAEDVPGHWLVTGAKLDVENGKISLGVKYSLLHY

SEQ ID NO: 937 - protein, 603 aa, Huperzia carriata (Solomon Islands)
MDNRAVLNSTVQSKAIEAVGALGRGYDVTLDLKLGYCKGSPESCLIELDKQHFHDIVVPGDFTLFNVSKDITCDKGERTRFRSDVLTFHEMSERFNQGLSINARIPLGLFNSMFNFRGPWHIDAQATKSLSLDGWFVTLYRMQIAKTPLVLCDEVKQAVPSSWDAAALANFIVKYGTHIVLSVKMGGKDVIYIRQQASSHLSPLEVQKYLKKIGDQKFRESKEPKEILNKEVTSAPTTMNLAQHLQFAKTYHSISFTSKKDIEIIMQRRGGNDFVEAHEEWLPTVSSAPEVISMTFVPIASLLNGVSGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQNSRWFEPVQWKGFSHVTTAPVELEGNATDTAFAYVVIGAQLQVWELDSKKVLFLRLLFLKIHGCSVRRSAWDHMPSLSQKSGLLSQLGLSTSMSSNQHAISTPFVQNSAVFPGGPPAPAPNAKLLKFVNITEMTKGAEDVPGHWLVTGAKLDVENGKISLGVKYSLLHY

SEQ ID NO: 938 - protein, 316 aa, Huperzia carriata (Philippines)
MSERFNQGLSINARIPLGLFNSMFNFRGPWHIDAQATKSLSLDGWFVTLYRMQITKTPLVLCDEVKQAVPSSWDAAALANFIVKYGTHIVLSVKMGGKDAIYIRQQASSQLSPLEVQKYLKKIGDQKFRESKEPKEILNKEVTSAPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKSSFVSWRKEVQ

SEQ ID NO: 939 - protein, 478 aa, Huperzia squarrosa
MSERFNQGTSINGRMPLGLFNSMFNFRGPWHIDAQATKSLSLDGWFVTLYKMQVSRTSLVLCDEVKQAVPSSWDAAALASFIEKYGTHIVLSVKMGGKDVIYIRQQASSNLSPLEVQKYLKKIGDQRFRESREPTDILNKEVTSAPTTMNLAQHLQFAKTYHSISLTSKKDIEIIMQRRGGNDFVEAHEGWLQTVSSAPEVISMTFVPIASLLNGVAGSGYLSHAINLYIRYKPPIEEIQQFLEFQIPRQWTPGYDLPLGPQRKEPLGPALQFSFLGPIRLYLGGKKFNRLSLHLQHLATLPKSLQPYWKTSLSSEARMWKEPEDQSSRWFEPVQWKGFSHVTTAPVELEANATDTAFAYVVIGAQLQVWELDSKKVLFLRLLFLKIHGCSVRRSAWDHMPSLSQKSGLLSQLGLSTSMSSNQHAVSTPFVQNSAVFPGGPPAPAPNAKLLKFVNITEMTKGAEDVPGHWLVTGAKLD

SEQ ID NO: 940 - protein, 603 aa, Platycerium bifurcatum
MDKRTVVYPTTREKGLEAVRALGRGYDVTLDLKLGYCKGSPQSCLIQLDNQNVHDIVVPGGFTLFNVSNDISCDKGERTRFRSDVLSFNEMSERFNQGISINGRMPLGLFNSMFNFRGPWHIDAQATKSLSLDGWFVTLYKMQIAKTPLVLCEEVKQAVPSSWDAAALANFIVKYGTHIVLSVKMGGKDAIYIRQQASSHLSPLEVQKYLKKIGDQKFRESKEPKEILNKEVTSVPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQNSRWFEPVQWKGFSHVTTAPVELEANATDTAFAYVVIGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNITEMTKGAQDLPGHWLVTGAKLDVENGKISLGVKYSLLHY

SEQ ID NO: 941 - protein, 251 aa, Selaginella kraussiana (Variegata)
MEQEKTSAHFTASEAVQALGKGFDVTLDLRLAGCKGPHGRLVELDDTGRGDLFVQDRVVIPNVSKDIRCDKGEFTHFRSEVLTFHQMSERFNQELSITGKMPLGLFNHMYSFNGPWQADASSTKSLALDGRFITSYKLQIAKSPLVLRDEVKRAVPASWDPAALAKFIDTYGTHVIVSIKVGGKDVLYVRQHQSSPLSTTELQKLIKRFADQRFADTNGSVSDPRNVKNKMQPDLLAGRLPIESDTITAKE

SEQ ID NO: 942 - protein, 603 aa, Huperzia salvinioides
MDKKAVSNSTVEAKALEAVGALGRGYDVTLDLKLSYCKGSPESCLIQLDKQHLHDIVVPGGFTLFNISKDITCDKGERTRFRSDVLTFHEMSERFNQGLSINARIPLGLFNSMFNFRGPWHIDAQATKSLSLDGWFVTLYKMQIAKTPLVLCDEVKQAVPSSWDAAALANFIVKYGTHIVLSVKMGGKDAIYIRQQASSHVSPLEVQKYLKKIGDQKFRESKEPKEILNKEVTSATTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSVHLQHLSTLPKSLQPYWKTSLSSEARLWKEPEDQNSRWFEPVQWKGFSHVTTAPVELEANATDTAFAYVVIGAQLQVWELDSKKVLFLRLLFLKIHGCSIRRSAWDHMPTLSQKSGLLSQLGLSTSMSSNQHAISTPFVQNSAVFPGGPPAPAPNAKLLKFVNITEMTKGAQDLPGHWLVTGAKLDVENGKISLGVKYSLLHY

SEQ ID NO: 943 - protein, 604 aa, Huperzia carriata (Solomon Islands)
MDNRAVLNSTVQSKAIEAVGALGRGYDVTLDLKLGYCKGSPESCLIELDKQHFHDIVVPGDFTLFNVSKDITCDKGERTRFRSDVLTFHEMSERFNQGLSINARIPLGLFNSMFNFRGPWHIDAQATKSLSLDGWFVTLYNMQVSRTSLVLCDEVKQAVPSSWDAAALASFIEKYGTHIVLSVKMGGKDVIYIRQQASSHLSPLEVQKYLKKIGDQRFRESREPKDTINKEATSTPTSMNLAQHLQIAKTYNSISFVSKKDIEIIKQRRGGSDFVKFHEEWLTTVSSAPEVISMTFVPIASLLNGVVGSGYLSHAINLYIRYKPPIEEIQQFLEFQIPRQWTPGYDLPLGPQRKEPLGPALQFSFLGPKLHVSTNQVSVGLRPVTGLRLYLGGKKFNRLSLHLQHLATLPKTLQPYWKTSLSGEARLWKEPEEQNSRWFEPVQWKGFSHVTTAPIELEPCATDTAFAYVVIGAQLQVWELDSKKVLFLRLLFLKIHGCSVRRSAWDHMPSLSQKSGILSQLGLSSTSMSSNKHPMSTPFVQNSAVFPGGPPAPAPNAKLLKFVNITEMTKGAEDVPGHWLVTGAKLDVENGKISLGVKYSLLHY

SEQ ID NO: 944 - protein, 604 aa, Huperzia nummulariifolia
MDKKAVSNSTVEAKALEAVGALGRGYDVTLDLKLSYCKGSPESCLIQLDKQHLHDIVVPGGFTLFNISKDITCDKGERTRFRSDVLSFNEMSERFNQGISINGRMPLGLFNSMFNFRGPWHIDAQATKSLSLDGWFVTLYKMQIAKTPLVLCEEVKQAVPSSWDAAALANFIVKYGTHIVLSVKMGGKDAIYIRQQASSHLSPLEVQKYLKKIGDQKFRESKEPKEILNKEVTSVPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQHFLEFQIPRQWTPGYDLPLGPQRKEPLGPALQFSFLGPKLHISTNEVSVGLRPVTGLRLYLGGKKFNRLSLHLQHLATVPKNLQPYWNTSSSNEAPVWKEPDEKNDRWFEPVQWKGFAHVATIPMEIEPHSKGTACAYIVTGAQLQVWELETKKVLFLRLLFSKIHGCSIRRSIWDHVASSFPQKPALFSQLGLSTSMSSNQQAMPTPFSLNSAVFPGGPPAPAPNAKLLKFVNTTEMTKGAKDLPGHWLVTGAKLDVENGKISLGVKYSLLHY

SEQ ID NO: 945 - protein, 606 aa, Selaginella biformis
MAQEKTSAYFTASEAVQALGKGFDTTLDLRLAGCKGPSGRLVELDETNREDLFVQDRVVIPNVSKDIRCDKGEFTHFRSEVLTFHQMSERFNQELSITGKMPLGLFNTMYSFNGPWQADASTTKSLALDGRFITSYKLQIVKSPLVLREEVKKAVPSSWDPAALAKFIDTYGTHIIVSVKVGGKDVVYVRQHQSSPLSPTELQKFIKRIADQKFAETNGSVSDSGNIKDKMQTPDLLAGSNHAHRLQLETFASSGGFTAKEDVEIIFRRRGGSNLLKSHNEWLKTVADAPDVISMTFVPITSLLNGVLGSGFLSHAVNLYLRHKPPIEDLQYFLEFQIPRQWSPGFDLPLGPQRKEPVCPAMQFSLMGPKLYVSTTQVTIGRRPVTGLRLFLEGKKCNRLGIHLQHLSSLPKILQPHWDSNVPIGPPVWKGPEEQDSKWFEPVQWKSFSHVSTQPVEFLEESYVGQTSGTYIVTGAQLGVWDFGMKKVLFLRLLFSRVPGCAIRRTVWDHSPTTSQKSGLFSQLGLSSTFSGAQKAKQAPVVLNSAVYPGGPPVPVPSPKLLKYVDITEMTKGAHDMPGHWIVTGAKLDVDRGRIALRLKYSVLHY

SEQ ID NO: 946 - protein, 608 aa, Huperzia squarrosa
MDKRTVVYPTAREKGLEAVRALGRGYDVTLDLKLGYCKGSPQSCLIQLDNQNVHDIVVPGGFTLFNVSKDISCDKGERTRFRSDVLSFHEMSERFNQGTSINGRMPLGLFNSMFNYNGPWHVDAQTTKSLALDGWFITLYKMQITTTSLVLRDEVKQEVPSAWDAAALANFIEKYGTHIVLSVKMGGKDVIYIRQQASSNLSPLEVQKYLKKIGDQRFRESREPTDILNKEVTSAPTTMNLAQHLQFAKTYHSISLTSKKDIEIIMQRRGGNDFVEAHEGWLQTVSSAPEVISMTFVPIASLLNGVAGSGYLSHAINLYIRYKPPIEEIQQFLEFQIPRQWTPGYDLPLGPQRKEPLGPALQFSFLGPKLHISTNQVSVGLRPVTGLRLYLGGKKFNRLSLHLQHLATLPKTLQPYWKTSLSSEARLWKEPEEQNSRWFEPVQWKGFSHVTTAPVELEPCATDTAFAYVVIGAQLQVWELDSKKVLFLRLLFLKIHGCSVRRSAWDHMPSLSQKSGLLSQLGLSTSMSSNQHAVSTPFVQNSAVFPGGPPAPAPNAKLLKFVNITEMTKGAEDVPGHWLVTGAKVTGAKLDVENGKISLGVKYSLLHY

SEQ ID NO: 947 - protein, 570 aa, Huperzia tetratoides
MSHDIVVPGDFTLFNVSKDITCDKGERTRFRSDVLSFHEMSERFNQGLSINARIPLGLFNSMFNFRGPWHIDAQATKSLSLDGWFVTLYKMQVSRTSMVLCDEVKQAVPSSWDAAALASFIEKYGTHIVLSVKMGGKDAIYIRQQASSHLSPLEVQKYLKKIGDQRFRESREPKDILNKEVRSAPTTMNLAQHLQFAKTYHSISFMSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKRFNRLSLHLQHLATLPKSLQPYWKTSLSSEARLWKSLQPYWKTSLSSEARLWKEPEDQSSRWFEPVQWKGFSHVTTAPVELEANATDTSFAYVVIGAQLQVWELDSKKVLFLRLLFLKIHGCSIRRSAWDHMPSLSQKSGLLSQLGLSTSMSSNQHAISTPFVQNSAVFPGGPPAPAPNAKLLKFVNITEMTKGAQDLPGHWLVTGAKLDVDNGKISLGVKYSLLHY

SEQ ID NO: 948 - protein, 604 aa, Huperzia salvinioides
MDKKAVSNSTVEAKALEAVGALGRGYDVTLDLKLSYCKGSPESCLIQLDKQHLHDIVVPGGFTLFNISKDITCDKGERTRFRSDVLTFHEMSERFNQGLSINARIPLGLFNSMFNFRGPWHIDAQATKSLSLDGWFVTLYKMQIAKTPLVLCDEVKQAVPSSWDAAALANFIVKYGTHIVLSVKMGGKDAIYIRQQASSHVSPLEVQKYLKKIGDQKFRESKEPKEILNKEVTSATTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSVHLQHLSTLPKSLQPYWKTSLSSEARLWKEPEDQNSRWFEPVQWKGFSHVTTAPVELEANATDTAFAYVVIGAQLQVWELETKKVLFLRLLFSKIHGCSIRRSIWDHVASSFPQKPALFSQLGLSTSMSSNQQAMPTPFSLNSAVFPGGPPAPASNAKLLKFVNTTEMTKGAQDLPGHWLVTGAKLDVENGKISLGVKYSLLHY

SEQ ID NO: 949 - protein, 274 aa, Huperzia nummarifolia
MQITTTSLVLRDEVKQAVPSTWDAAALANFIEKYGTHIVLSVKMGGKDVIYIRQQAQSQLSPFEIQKNLKKIGDLKFHGSRESNYTLNKEVISASTSKNFVQHLPVSNTYDSISFVSQKDIEIIKQRRGGDKFVEAHEDWVTTISSAPEVISMTFVPITSLLSGVLGSGFLSHAINLYMRYKPPIEEIQHFLEFQIPRQWTPGYDLPLGPPRKEPLGPALQFSFLGPKLHISTNQVAVGHRPVTGLRLCLGGKKFNRLSLHLQHLATVPKNLQP

SEQ ID NO: 950 - protein, 603 aa, Huperzia carinata
MDKKAVSNSTGEAKALEAVGALGRGYDVTLDLKLSYCKGSPESCLIQLDKQHLHDIVVPGGFTLFNISKDITCDKGERTRFRSDVLNFHEMSERFNQGLSINARIPLGLFNSMFNFRGPWHIDAQATKSLSLDGWFVTLYRMQIAKTPLVLCDEVKQAVPSSWDAAALANFIVKYGTHIVLSVKMGGKDAIYIRQQASSQLSPLEVQKYLKKIGDQRFRESREPKDIINKEATSTPTSMNLAQHLQIAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQNSRWFEPVQWKGFSHVTTAPVELEANATDTAFAYVVIGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNITEMTKGAQDLPGHWLVTGAKLDVENGKISLGVKYSLLHY

SEQ ID NO: 951 - protein, 597 aa, Huperzia carriata (Solomon Islands)
MDNRAVLNSTVQSKAIEAVGALGRGYDVTLDLKLGYCKGSPESCLIELDKQHFHDIVVPGDFTLFNVSKDITCDKGERTRFRSDVLTFHEMSERFNQGLSINARIPLGLFNSMFNFRGPWHIDAQATKSLSLDGWFVTLYNMQVSRTSLVLCDEVKQAVPSSWDAAALASFIEKYGTHIVLSVKMGGKDVIYIRQQASSHLSPLEVQKYLKKIGDQRFRESREPKDTINKEATSTPTSMNLAQHLQIAKTYNSISFVSKKDIEIIKQRRGGSDFVKFHEEWLTTVSSAPEVISMTFVPIASLLNGVVGSGYLSHAINLYIRYKPPIEEIQQFLEFQIPRQWTPGYDLPLGPQRKEPLGPALQFSFLGPKLHVSTNQVSVGLRPVTGLRLYLGGKKFNRLSLHLQHLATLPKTLQPYWKTSLSGEARLWKEPEEQNSRWFEPVQWKGFSHVTTAPIELEPCATDTAFAYVVIGAQLQVWELDSKKVLFLRLLFLKIHGCSVRRSAWDHMPSLSQKSGILSQLGLSSTSMSSNKHPMSTPFVQNSAVFPGGPPAPAPNAKLLKFVNITEMTKGAEDVPGHWLVTGAKLDVENGKISLGV

SEQ ID NO: 952 - protein, 604 aa, Huperzia tetratoides
MDKRTVVYPTAREKGLEAVRALGRGYDVTLDLKLGYCKGSRQSCLIQLDNENVHDIVVPGGFTLCNVSKDISCDKGERTRFRSDVLSFHEMSERFNQGLSINARIPLGLFNSMFNYNGPWHVDAQTTKSLALDGWFITLYKMQITKTSLVLRDEVKQEVPSAWDAAALANFIEKYGTHIVLSVKMGGKDVIYIRQQALSQLSPFEIQKNLKKIGDLSFHGSRESNHTLNKEVISASTSKHFAQHLPISHTYDSISFVSQKDIEIIEQRRGGDKFVKAHEDWVTTISSAPEVISMTFVPITSLLSGVLGSGFLSHAINLYMRYKPPVEEIQHFLEFQIPRQWTPGYDLPLGPPRKEPLGPALQFSFLGPKLYISTNQVTVGQRPVTGLRLCLGGKKFNRLSLHLQHLATVPKNLQPYWNTSSSSEAPVWKEPEEKSDRWFEPVQWKGFSHVATLPVEIEPHSKGTARAYIVTGAQLQVWELDTKKVLFLRLLFSKIHGCSIRRSIWDHVASSFSQKPALFSQLGLSTSMPSNQQAMPTPFSLNSAVFPGGPPAPAPNAKLLKFVNITEMTKGAQDLPGHWLVTGAKLDVENGKISLAVKYSLLHY

SEQ ID NO: 953 - protein, 603 aa, Huperzia carriata (Solomon Islands)
MDKKAVSNSTVEAKALEAVGALGRGYDVTLDLKLSYCKGSPESCLIQLDKQHLHDIVVPGGFTLFNISKDITCDKGERTRFRSDVLTFHEMSERFNQGLSINARIPLGLFNSMFNFRGPWHIDAQATKSLSLDGWFVTLYRMQIAKTPLVLCDEVKQAVPSSWDAAALANFIVKYGTHIVLSVKMGGKDVIYIRQQASSHLSPLEVQKYLKKIGDQRFRESREPKDTINKEATSTPTSMNLAQHLQIAKTYNSISFVSKKDIEIIKQRRGGSDFVKFHEEWLTTVSSAPEVISMTFVPIASLLNGVVGSGYLSHAINLYIRYKPPIEEIQQFLEFQIPRQWTPGYDLPLGPQRKEPLGPALQFSFLGPKLHVSTNQVSVGLRPVTGLRLYLGGKKFNRLSLHLQHLSTLPKSLQPYWKTSLSSEARLWKEPEDQNSRWFEPVQWKGFSHVTTAPVELEGNATDTAFAYVVIGAQLQVWELDSKKVLFLRLLFLKIHGCSVRRSAWDHMPSLSQKSGLLSQLGLSTSMSSNQHAISTPFVQNSAVFPGGPPAPAPNAKLLKFVNITEMTKGAEDVPGHWLVTGAKLDVENGKISLGVKYSLLHY

SEQ ID NO: 954 - protein, 402 aa, Huperzia nummulariifolia (Blume)
MNLAQHLQFAKTYHSISFTSKKDIEIIMQRRGGNDFVEAHEEWLPTVSSAPEVISMTFVPIASLLNGVAGSGYLSHAINLYIRYKPPIEEIQHFLEFQNAINLYIRYKPPIEEIQQFLEFQIPRQWTPGYDLPLGPQRKEPLGPALQFSFLGPKLHISTNEVSVGLRPVTGLRLYLGGKKFNRLSVHLQHLSTLPKSLQPYWKTSLSSEARLWKEPEDQNSRWFEPVQWKGFSHVTTAPVELEANATDTAFAYVVIGAQLQVWELDSGCSIRRSAWDHMPTLSQKSGLLSQLGLSTSMSSNQHAISTPFVQNSAVFPGGPPAPAPNAKLLKFVNITEMTKGAEDIPGHWLVTGAKLDVENGKISLGVGHWLVTGVQSLMLRMGKYPWVLNIHSYIIEISLGS

SEQ ID NO: 955 - protein, 514 aa, Huperzia carriata (Philippines)
MSERFNQGLSINARIPLGLFNSMFNFRGPWHIDAQATKSLSLDGWFVTLYRMQITKTPLVLCDEVKQAVPSSWDAAALANFIVKYGTHIVLSVKMGGKDAIYIRQQASSQLSPLEVQKYLKKIGDQKFRESKEPKEILNKEVTSAPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQSSRWFEPVQWKGFSHVTTAPVELEANATDTAFAYVVIGAQLQVWELETKKVLFLRVLFSKIHGCSIRRSIWDHVASSFPQKPALFSQLGLSTSMSSNQQAMPTPFSLNSAVFPGGPPAPVPNAKLLKFVNTTEMTKGAKDLPGHWLVTGAKLDVEDGKISLGVKYSLLHY

SEQ ID NO: 956 - protein, 601 aa, Platycerium bifurcatum
MDKRTVVYPTTREKGLEAVRALGRGYDVTLDLKLGYCKGSPQSCLIQLDNQNVHDIVVPGGFTLFNVSNDISCDKGERTRFRSDVLSFNEMSERFIKVFLSMVPLGLFNSMFNYNGPWHVDAQTTKSLALDGWFITLYKMQITTTSLVLRDEVKQAVPSTWDAAALANFIEKYGTHIVLSVKMGGKDAIYIRQQASSHLSPLEVQKYLKKIGDQKFRESKEPKEILNKEVTSVPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQHFLEFQIPRQWTPGYDLPLGPPRKEPLGPALQFSFLGPKLHISTNQVAVGHRPVTGLRLCLGGKKFNRLSLHLQHLSTLPKSLQPYWKTSLSSEARLWKEPEDQNSRWFEPVQWKGFSHVTTAPVELEANATDTAFAYVVIGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNITEMTKGAQDLPGHWLVTGAKLDVENGKISLGVKYSLLHY

SEQ ID NO: 957 - protein, 296 aa, Huperzia salvinioides
MDKRAVLNSTVQSKAIEAVGALGRGYDVTLDLKLGYCKGSPESCLIELDKQHFHDIVVPGDFTLFNVSKDITCDKGERTRFRSDVLSFHEMSERFNQGLSINARIPLGLFNSMFNFRGPWHIDAQATKSLSLDGWFVTLYNMQVSRTSLVLCDEVKQAVPSSWDAAALASFIEKYGTHIVLSVKMGGKDAIYIRQQASSHVSPLEVQKYLKKIGDQRFRESREPKDIINKEATSTPTSMNLAQHLQIAKTYHSISFVSKKDIINKEATSTPTSMNLAQHLQIAKTYHSISFVSKKD

SEQ ID NO: 958 - protein, 523 aa, Huperzia carriata (Philippines)
MSERFNQGLSINARIPLGLFNSMFNFRGPWHIDAQATKSLSLDGWFVTLYNMQVSRTSLVLCDEVKQAVPSSWDAAALASFIEKYGTHIVLSVKMGGKDAIYIRQQASSQLSPLEVQKYLKKIGDQKFRESKEPKEILNKEVTSAPTTMNLAQHLQFAKTYHSILQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQSSRWFEPVQWKGFSHVTTAPVELEANATDTAFAYVVIGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNTTEMTKGAKDLPGHWLVTGAKLDVENGKISLGVKYSLLHY

SEQ ID NO: 959 - protein, 365 aa, Huperzia nummarifolia
MNLAQHLQIAKTYHSISFVSKKDIEIIKQRRGGSDFVKSHEEWLTTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQNSRWFEPVQWKGFSHVTTAPVELEANATDTAFAYVVIGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNITEMTKGAQDLPGHWLVTGAKLDVENGKISLGVKYSLLHY

SEQ ID NO: 960 - protein, 607 aa, Huperzia carinata
MDKRTVVYPTTREKGLEAVRALGRGYDVTLDLKLGYCKGSPKSCLIQLDNQNVHDIVVPGGFTLFNVSKDISCDKGERTRFRSDVLNFHEMSERFNQGLSINARIPLGLFNSMFNYNGPWHVDAQTTKSLALDGWFITLYKMQITMTSLVLRDEVKQAVPSTWDAAALANFIEKYGTHIVLSVKMGGKDAIYIRQQASSQLSPLEVQKYLKKIGDQRFRESREPKDIINKEATSTPTSMNLAQHLQIAKTYHSISFVSKKDIEIIKQRRGGSDFVKSHEEWLTTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQNSRWFEPVQWKGFSHVTTAPVELEANATDTAFAYVVIGAQLQVWELDSKKVLFLRLLFFKIQGCSIRRSAWDHMPSLSQMSQKSGILSQLGLSSTSMSSNKHAMSTPFVQNSAVFPGGPPAPAPNAKLLKFVNITEMTKGAQDLPGHWLVTGAKLDVENGKISLGVKYSLLHY

SEQ ID NO: 961 - protein, 604 aa, Huperzia nummarifolia
MDKRTVVYPTTRDKGLEAVRALGRGYDVTLDLKLGYCKGSPKSCLIQLDNQNVHDIVVPGGFTLFNVSKDISCDKGERTRFRSDVLTFHEMSERFNQGLSINARIPLGLFNSMFNFRGPWHIDAQATKSLSLDGWFVTLYKMQIAKTPLVLCEEVKQAVPSSWDAAALANFIVKYGTHIVLSVKMGGKDAIYIRQQASSHLSPLEVQKYLKKIGDQKFRESKEPKEILNKEVTSVPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLATVPKNLQPYWNTSSSNEAPVWKEPDEKDDRWFEPVQWKGFAHVATIPMEIEPHSKGTACAYIVTGAQLQVWELETKKVLFLRLLFSKIHGCSIRRSIWDHVASSFPQKPALFSQLGLSTSMSSNQQAMPTPFSLNSAVFPGGPPAPAPNAKLLKFVNTTEMTKGAKDLPGHWLVTGAKLDVENGKISLGVKYSLLHY

SEQ ID NO: 962 - protein, 496 aa, Huperzia carinata
MDKRAVLNSTVQSKAIEAVGALGRGYDVTLDLKLGYCKGSPESCLIELDKQHFHDIVVPGDFTLFNVSKDITCDKGERTRFRSDVLNFHEMSERFNQGLSINARIPLGLFNSMFNFRGPWHIDAQATKSLSLDGWFVTLYNMQVSRTSLVLCDEVKQAVPSSWDAAALASFIEKYGTHIVLSVKMGGKDAIYIRQQASSQLSPLEVQKYLKKIGDQKFRESKEPKEILNKEVTSAPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQNSRWFEPVQWKGFSHVTTAPVELEANATDTAFAYVVIGAQWSTAASLGAGFKEGAISETLVL

SEQ ID NO: 963 - protein, 507 aa, Huperzia carriata (Solomon Islands)
MSERFNQGLSINARIPLGLFNSMFNFRGPWHIDAQATKSLSLDGWFVTLYRMQIAKTPLVLCDEVKQAVPSSWDAAALANFIVKYGTHIVLSVKMGGKDVIYIRQQASSHLSPLEVQKYLKKIGDQRFRESREPKDTINKEATSTPTSMNLAQHLQIAKTYNSISFVSKKDIEIIKQRRGGSDFVKFHEEWLTTVSSAPEVISMTFVPIASLLNGVVGSGYLSHAINLYIRYKPPIEEIQQFLEFQIPRQWTPGYDLPLGPQRKEPLGPALQFSFLGPKLHVSTNQVSVGLRPVTGLRLYLGGKKFNRLSLHLQHLATLPKTLQPYWKTSLSGEARLWKEPEEQNSRWFEPVQWKGFSHVTTAPIELEPCATDTAFAYVVIGAQLQVWELDSKKVLFLRLLFLKIHGCSVRRSAWDHMPSLSQKSGILSQLGLSSTSMSSNKHPMSTPFVQNSAVFPGGPPAPAPNAKLLKFVNITEMTKGAEDVPGHWLVTGAKLDVENGKISLGV

SEQ ID NO: 964 - protein, 604 aa, Huperzia phlegmaria
MDKRTVVYLTTREKGLEAVRALGRGYDVTLDLKLGYCKGSPKSCLIQLDNQNVHDIVVPGGFTLSNVSKDISCDKGERTRFRSDVLSFNEMSERFNQGLSINARIPLGLFNSMFNFRGPWHIDAQATKSLSLDGWFVTLYKMQIAKTPLVLCDEVKQAVPSSWDAAALANFIVKYGTHIVLSVKMGGKDAIYIRQQASSHLSPLEVQKYLKKIGDQKFREFKEPKEILNKEVTSAPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVTVGHRPVTGLRLCLGGKKFNRLSLHLQHLATVPKNLQPYWNTSSSNEAPVWKEPDEKNDRWFEPVQWKGFAHVTTIPMEIEPHSKGTACAYIVTGAQLQVWELETKKVLFLRLLFSKIHGCSIRRSIWDHVASSFPQKPALFSQLGLSTSMSSNQQAMPTPFSLNSAVFPGGPPAPAPNAKLLKFVNTTEMTKGAQDLPGHWLVTGAKLDVENGKISLGVKYSLLHY

SEQ ID NO: 965 - protein, 419 aa, Platycerium bifurcatum
MGGKDVIYIRQQAQSQLSPFEIQKNLKKIGDLKFHGSRESNYTLNKEVISASTSKNFVQHLPVSNTYDSISFVSQKDIEIIKQRRGGDKFVEAHEDWVTTISSAPEVISMTFVPITSLLSGVLGSGFLSHAINLYMRYKPPIEEIQHFLEFQIPRQWTPGYDLPLGPPRKEPLGPALQFSFLGPKLHISTNQVAVGHRPVTGLRLCLGGKKFNRLSLHLQHLSTLPKSLQPYWKTSLSSEARLWKEPEDQNSRWFEPVQWKGFSHVTTAPVELEANATDTAFAYVVIGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNITEMTKGAQDLPGHWLVTGAKLDVENGKISLGVKYSLLHY

SEQ ID NO: 966 - protein, 505 aa, Huperzia nummarifolia
MFNFRGPWHIDAQATKSLSLDGWFVTLYKMQIAKTPLVLCEEVKQAVPSSWDAAALANFIVKYGTHIVLSVKMGGKDAIYIRQQASSHLSPLEVQKYLKKIGDQKFRESKEPKEILNKEVTSVPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQNSRWFEPVQWKGFSHVTTAPVELEANATDTAFAYVVIGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNITEMTKGAQDLPGHWLVTGAKLDVENGREWKNIPWCEIFTSTLLSFWKKKLAIR

SEQ ID NO: 967 - protein, 603 aa, Huperzia carinata
MDKRTVVYPTTREKGLEAVRALGRGYDVTLDLKLGYCKGSPKSCLIQLDNQNVHDIVVPGGFTLFNVSKDISCDKGERTRFRSDVLNFHEMSERFNQGLSINARIPLGLFNSMFNFRGPWHIDAQATKSLSLDGWFVTLYRMQIAKTPLVLCDEVKQAVPSSWDAAALANFIVKYGTHIVLSVKMGGKDAIYIRQQASSQLSPLEVQKYLKKIGDQRFRESREPKDIINKEATSTPTSMNLAQHLQIAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLATVPKNLQAYWNTSSSNEAPVWKEPDEKNDRWFEPVQWKGFSHVTTIPMEIEPHSKGAACAFIVTGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNITEMTKGAQDLPGHWLVTGAKLDVENGKISLGVKYSLLHY

SEQ ID NO: 968 - protein, 517 aa, Platycerium bifurcatum
MRCRRDSIKVFLSMVNGRMPLGLFNSMFNYNGPWHVDAQTTKSLALDGWFITLYKMQITTTSLVLRDEVKQAVPSTWDAAALANFIEKYGTHIVLSVKMGGKDAIYIRQQASSHLSPLEVQKYLKKIGDQKFRESKEPKEILNKEVTSVPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQNSRWFEPVQWKGFSHVTTAPVELEANATDTAFAYVVIGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNITEMTKGAQDLPGHWLVTGAKLDVENGKISLGVKYSLLHY

SEQ ID NO: 969 - protein, 605 aa, Huperzia carinata
MDKRAVLNSTVQSKAIEAVGALGRGYDVTLDLKLGYCKGSPESCLIELDKQHFHDIVVPGDFTLFNVSKDITCDKGERTRFRSDVLNFHEMSERFNQGLSINARIPLGLFNSMFNFRGPWHIDAQATKSLSLDGWFVTLYNMQVSRTSLVLCDEVKQAVPSSWDAAALASFIEKYGTHIVLSVKMGGKDAIYIRQQASSQLSPLEVQKYLKKIGDQRFRESREPKDIINKEATSTPTSMNLAQHLQIAKTYHSISFVSKKDIEIIKQRRGGSDFVKSHEEWLTTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLATLPKTLQPYWKTSLSGEARLWKEPEEQNSRWFEPVQWKGFSHVTTAPIELEPCATDTAFAYVVIGAQLQVWELDSKKVLFLRLLFFKIQGCSIRRSAWDHMPSLSQKKSGILSQLGLSSTSMSSNKHAMSTPFVQNSAVFPGGPPAPAPNAKLLKFVNITEMTKGAQDLPGHWLVTGAKLDVENGKISLGVKYSLLHY

SEQ ID NO: 970 - protein, 463 aa, Huperzia carinata
MQITMTSLVLRDEVKQAVPSTWDAAALANFIEKYGTHIVLSVKMGGKDVIYIRQQAQSQLSPFEIQKNLKNIGDLKFHGSRESSYTLNKEVISASTSKNFVQHLPVSNTYDSISFVSQKDIEIIKQRRGGDKFVEAHEDWVTTISSAPEVISMTFVPITSLLSGVLGSGFLSHAINLYMRYKPPIEEIQHFLEFQIPRQWTPGYDLPLGPPRKEPLGPALQFSFLGPKLRISTNQVTVGHKPVTGLRLCLGGKKLNRLSLHLQHLATVPKNLQAYWNTSSSNEAPVWKEPDEKNDRWFEPVQWKGFSHVTTIPMEIEPHSKGAACAFIVTGAQLQVWELETKKVLFLRVLFSKIHGCSIRRSIWDHVASSFPQKPALFSQLGLSTSMSSNQQAMPTPFSLNSAVFPDGPPAPAPNAKLLKFVNTTEMTKGAKDLPGHWLVTGAKLDVENGKISLGVKYSLLHY

SEQ ID NO: 971 - protein, 435 aa, Huperzia tetratoides
MSHDIVVPGDFTLFNVSKDITCDKGERTRFRSDVLSFHEMSERFNQGLSINARIPLGLFNSMFNFRGPWHIDAQATKSLSLDGWFVTLYKMQVSRTSMVLCDEVKQAVPSSWDAAALASFIEKYGTHIVLSVKMGGKDAIYIRQQASSHLSPLEVQKYLKKIGDQRFRESREPKDILNKEVRSAPTTMNLAQHLQFAKTYHSISFMSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNQVSVGLRPVTGLRLNLGGKKFNRLSLHLQHLATLPKTLQPYWKTSLSSEARLWKEPEEQNSRWFEPVQWKGFSHVTTAPVELEPSATDTAFAYVVIGAQLQVCWIRRKYYF

SEQ ID NO: 972 - protein, 404 aa, Platycerium bifurcatum
MGGKDAIYIRQQASSHLSPLEVQKYLKKIGDQKFRESKEPKEILNKEVTSVPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQHFLEFQIPRQWTPGYDLPLGPPRKEPLGPALQFSFLGPKLHISTNQVAVGHRPVTGLRLCLGGKKFNRLSLHLQHLSTLPKSLQPYWKTSLSSEARLWKEPEDQNSRWFEPVQWKGFSHVTTAPVELEANATDTAFAYVVIGAQLQVWELDSKKVLFLRLLFFKIQGCSIRRSAWDHMPSLSQKSGILSQLGLSSTSMSSNKHAVSTPHPCLRSPAFCHSWDSVHQCHQINMQYQHRLCKTQLYFLEDLLHLHPMQNC

SEQ ID NO: 973 - protein, 603 aa, Huperzia nummarifolia
MDKRTVVYPTTRDKGLEAVRALGRGYDVTLDLKLGYCKGSPKSCLIQLDNQNVHDIVVPGGFTLFNVSKDISCDKGERTRFRSDVLTFHEMSERFNQGLSINARIPLGLFNSMFNFRGPWHIDAQATKSLSLDGWFVTLYKMQIAKTPLVLCEEVKQAVPSSWDAAALANFIVKYGTHIVLSVKMGGKDAIYIRQQASSHLSPLEVQKYLKKIGDQKFRESKEPKEILNKEVTSVPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLATVPKNLQPYWNTSSSNEAPVWKEPDEKDDRWFEPVQWKGFAHVATIPMEIEPHSKGTACAYIVTGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNITEMTKGAQDLPGHWLVTGAKLDVENGKISLGVKYSLLHY

SEQ ID NO: 974 - protein, 513 aa, Huperzia carriata (Philippines)
MSERFNQGLSINARIPLGLFNSMFNFRGPWHIDAQATKSLSLDGWFVTLYRMQITKTPLVLCDEVKQAVPSSWDAAALANFIVKYGTHIVLSVKMGGKDAIYIRQQASSQLSPLEVQKYLKKIGDQRFRESREPKDIINKEATSTPTSMNLAQHLQIAKTYNSISFVSKKDIEIIKQRRGGSDFVKSHEEWLTTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQSSRWFEPVQWKGFSHVTTAPVELEANATDTAFAYVVIGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNTTEMTKGAKDLPGHWLVTGAKLDVENGKISLGVKYSLLHY

SEQ ID NO: 975 - protein, 603 aa, Huperzia nummulariifolia
MDKKAVSNSTVEAKALEAVGALGRGYDVTLDLKLSYCKGSPESCLIQLDKQHLHDIVVPGGFTLFNISKDITCDKGERTRFRSDVLSFNEMSERFNQGISINGRMPLGLFNSMFNYNGPWHVDAQTTKSLALDGWFITLYKMQITTTSLVLRDEVKQAVPSTWDAAALANFIEKYGTHIVLSVKMGGKDAIYIRQQASSHLSPLEVQKYLKKIGDQKFRESKEPKEILNKEVTSVPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQHFLEFQIPRQWTPGYDLPLGPQRKEPLGPALQFSFLGPKLHISTNEVSVGLRPVTGLRLYLGGKKFNRLSLHLQHLATVPKNLQPYWNTSSSNEAPVWKEPDEKNDRWFEPVQWKGFAHVATIPMEIEPHSKGTACAYIVTGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNITEMTKGAQDLPGHWLVTGAKLDVENGKISLGVKYSLLHY

SEQ ID NO: 976 - protein, 603 aa, Huperzia carriata (Philippines)
MDKKAVSNSTVEAKALEAVGALGRGYDVTLDLKLSYCKGSPESCLLQLDKQHLHDIVVPGGFTLFNISKDITCDKGERTRFRSDVLSFNEMSERFNQGLSINARIPLGLFNSMFNFRGPWHIDAQATKSLSLDGWFVTLYRMQITKTPLVLCDEVKQAVPSSWDAAALANFIVKYGTHIVLSVKMGGKDAIYIRQQASSQLSPLEVQKYLKKIGDQKFRESKEPKEILNKEVTSAPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQSSRWFEPVQWKGFSHVTTAPVELEANATDTAFAYVVIGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNTTEMTKGAKDLPGHWLVTGAKLDVENGKISLGVKYSLLHY

SEQ ID NO: 977 - protein, 603 aa, Huperzia carriata (Solomon Islands)
MDNRAVLNSTVQSKAIEAVGALGRGYDVTLDLKLGYCKGSPESCLIELDKQHFHDIVVPGDFTLFNVSKDITCDKGERTRFRSDVLTFHEMSERFNQGLSINARIPLGLFNSMFNFRGPWHIDAQATKSLSLDGWFVTLYRMQIAKTPLVLCDEVKQAVPSSWDAAALANFIVKYGTHIVLSVKMGGKDVIYIRQQASSHLSPLEVQKYLKKIGDQRFRESREPKDTINKEATSTPTSMNLAQHLQIAKTYNSISFVSKKDIEIIKQRRGGSDFVKFHEEWLTTVSSAPEVISMTFVPIASLLNGVVGSGYLSHAINLYIRYKPPIEEIQQFLEFQIPRQWTPGYDLPLGPQRKEPLGPALQFSFLGPKLHVSTNQVSVGLRPVTGLRLYLGGKKFNRLSLHLQHLSTLPKSLQPYWKTSLSSEARLWKEPEDQNSRWFEPVQWKGFSHVTTAPVELEGNATDTAFAYVVIGAQLQVWELDSKKVLFLRLLFLKIHGCSVRRSAWDHMPSLSQKSGLLSQLGLSTSMSSNQHAISTPFVQNSAVFPGGPPAPAPNAKLLKFVNITEMTKGAEDVPGHWLVTGAKLDVENGKISLGVKYSLLHY

SEQ ID NO: 978 - protein, 604 aa, Huperzia salvinioides
MDKKAVSNSTVEAKALEAVGALGRGYDVTLDLKLSYCKGSPESCLIQLDKQHLHDIVVPGGFTLFNISKDITCDKGERTRFRSDVLTFHEMSERFNQGLSINARIPLGLFNSMFNFRGPWHIDAQATKSLSLDGWFVTLYKMQIAKTPLVLCDEVKQAVPSSWDAAALANFIVKYGTHIVLSVKMGGKDAIYIRQQASSHVSPLEVQKYLKKIGDQKFRESKEPKEILNKEVTSATTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSVHLQHLSTLPKSLQPYWKTSLSSEARLWKEPEDQNSRWFEPVQWKGFSHVTTAPVELEANATDTAFAYVVIGAQLQVWELDSKKVLFLRLLFLKIHGCSVRRSAWDHMPSLSQKSGILSQLGLSSTSMSSNKHAVSTPFVQNSAVFAGGPPAPAPNAKLLKFVNITEMTKGAQDLPGHWLVTGAKLDVENGKISLGVKYSLLHY

SEQ ID NO: 979 - protein, 557 aa, Huperzia nummarifolia
MDKRTVVYPTTRDKGLEAVRALGRGYDVTLDLKLGYCKGSPKSCLIQLDNQNVHDIVVPGGFTLFNVSKDISCDKGERTRFRSDVLSFNEMSERPWHVDAQTTKSLALDGWFITLYKMQITTTSLVLRDEVKQAVPSTWDAAALANFIEKYGTHIVLSVKMGGKDVIYIRQQAQSQLSPFEIQKNLKKIGDLKFHGSRESNYTLNKEVISASTSKNFVQHLPVSNTYDSISFVSQKDIEIIKQRRGGDKFVEAHEDWVTTISSAPEVISMTFVPITSLLSGVLGSGFLSHAINLYMRYKPPIEEIQHFLEFQIPRQWTPGYDLPLGPPRKEPLGPALQFSFLGPKLHISTNQVAVGHRPVTGLRLCLGGKKFNRLSLHLQHLSTLPKSLQPYWKTSLSSEARLWKEPEDQNSRWFEPVQWKGFSHVTTAPVELEANATDTAFAYVVIGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNITEMTKGAQDLIKVCEHH

SEQ ID NO: 980 - protein, 514 aa, Huperzia tetratoides
MSERFNQGLSINARIPLGLFNSMFNYNGPWHVDAQTTKSLALDGWFITLYKMQITKTSLVLRDEVKQEVPSAWDAAALANFIEKYGTHIVLSVKMGGKDVIYIRQQALSQLSPFEIQKNLKKIGDLSFHGSRESNHTLNKEVISASTSKHFAQHLPISHTYDSISFVSQKDIEIIEQRRGGDKFVKAHEDWVTTISSAPEVISMTFVPITSLLSGVLGSGFLSHAINLYMRYKPPVEEIQHFLEFQIPRQWTPGYDLPLGPPRKEPLGPALQFSFLGPKLYISTNQVTVGQRPVTGLRLCLGGKKFNRLSLHLQHLATVPKNLQPYWNTSSSSEAPVWKEPEEKSDRWFEPVQWKGFSHVATLPVEIEPHSKGTARAYIVTGAQLQVWELDTKKVLFLRLLFSKIHGCSIRRSIWDHVASSFSQKPALFSQLGLSTSMPSNQQAMPTPFSLNSAVFPGGPPAPAPNAKLLKFVNITEMTKGAQDLPGHWLVTGAKLDVENGKISLAVKYSLLHY

SEQ ID NO: 981 - protein, 603 aa, Platycerium bifurcatum
MDKKAVSNSTVEAKALEAVGALGRGYDVTLDLKLSYCKGSPESCLIQLDKQHLHDIVVPGGFTLFNISKDITCDKGERTRFRSDVLSFNEMSERFNQGISINGRMPLGLFNSMFNFRGPWHIDAQATKSLSLDGWFVTLYKMQIAKTPLVLCEEVKQAVPSSWDAAALANFIVKYGTHIVLSVKMGGKDAIYIRQQASSHLSPLEVQKYLKKIGDQKFRESKEPKEILNKEVTSVPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLATVPKNLQPYWNTSSSNEAPVWKEPDEKNDRWFEPVQWKGFAHVATIPMEIEPHSKGTACAYIVTGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNITEMTKGAQDLPGHWLVTGAKLDVENGKISLGVKYSLLHY

SEQ ID NO: 982 - protein, 603 aa, Huperzia salvinioides
MDKRAVLNSTVQSKAIEAVGALGRGYDVTLDLKLGYCKGSPESCLIELDKQHFHDIVVPGDFTLFNVSKDITCDKGERTRFRSDVLTFHEMSERFNQGLSINARIPLGLFNSMFNFRGPWHIDAQATKSLSLDGWFVTLYKMQIAKTPLVLCDEVKQAVPSSWDAAALANFIVKYGTHIVLSVKMGGKDAIYIRQQASSHVSPLEVQKYLKKIGDQKFRESKEPKEILNKEVTSATTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSVHLQHLSTLPKSLQPYWKTSLSSEARLWKEPEDQNSRWFEPVQWKGFSHVTTAPVELEANATDTAFAYVVIGAQLQVWELDSKKVLFLRLLFLKIHGCSIRRSAWDHMPTLSQKSGLLSQLGLSTSMSSNQHAISTPFVQNSAVFPGGPPAPAPNAKLLKFVNITEMTKGAQDLPGHWLVTGAKLDVENGKISLGVKYSLLHY

SEQ ID NO: 983 - protein, 409 aa, Huperzia carinata
MSERFNQGLSINARIPLGLFNSMFNFRGPWHIDAQATKSLSLDGWFVTLYRMQIAKTPLVLCDEVKQAVPSSWDAAALANFIVKYGTHIVLSVKMGGKDAIYIRQQASSQLSPLEVQKYLKKIGDQKFRESKEPKEILNKEVTSAPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQNSRWFEPVQWKGFSHVTTAPVELEANATDTAFAYVVIGAQLQVWSTAASLGAGFKEGAISETLVL

SEQ ID NO: 984 - protein, 603 aa, Huperzia nummarifolia
MDKRTVVYPTTRDKGLEAVRALGRGYDVTLDLKLGYCKGSPKSCLIQLDNQNVHDIVVPGGFTLFNVSKDISCDKGERTRFRSDVLTFHEMSERFNQGLSINARIPLGLFNSMFNFRGPWHIDAQATKSLSLDGWFVTLYKMQIAKTPLVLCEEVKQAVPSSWDAAALANFIVKYGTHIVLSVKMGGKDVIYIRQQAQSQLSPFEIQKNLKKIGDLKFHGSRESNYTLNKEVISASTSKNFVQHLPVSNTYDSISFVSQKDIEIIKQRRGGDKFVEAHEDWVTTISSAPEVISMTFVPITSLLSGVLGSGFLSHAINLYMRYKPPIEEIQQFLEFQIPRQWTPGYDLPLGPQRKEPLGPALQFSFLGPKLHISTNEVSVGLRPVTGLRLYLGGKKFNRLSLHLQHLATVPKNLQPYWNTSSSNEAPVWKEPDEKDDRWFEPVQWKGFAHVATIPMEIEPHSKGTACAYIVTGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNITEMTKGAQDLPGHWLVTGAKLDVENGKISLGVKYSLLHY

SEQ ID NO: 985 - protein, 588 aa, Platycerium bifurcatum
MDKRTVVYPTTREKGLEAVRALGRGYDVTLDLKLGYCKGSPQSCLIQLDNQNVHDIVVPGGFTLFNVSNDISCDKGERTRFRSDVLSFNEMSERFNQGISINGRMPLGLFNSMFNFRGPWHIDAQATKSLSLDGWFVTLYKMQIAKTPLVLCEEVKQAVPSSWDAAALANFIVKYGTHIVLSVKMGGKDAIYIRQQASSHLSPLEVQKYLKKIGDQKFRESKEPKEILNKEVTSVPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLATVPKNLQPYWNTSSSNEAPVWKEPDEKNDRWFEPVQWKGFAHVATIPMEIEPHSKGTACAYIVTGAQLQVWELDSKKVLFLRLLFFKIQGCSIRRSAWDHMPSLSQKSGILSQLGLSSTSMSSNKHAVSTPHPCLRSPAFCHSWDSVHQCHQINMQYQHRLCKTQLYFLEDLLHLHPMQNC

SEQ ID NO: 986 - protein, 603 aa, Platycerium bifurcatum
MDKRTVVYPTTREKGLEAVRALGRGYDVTLDLKLGYCKGSPQSCLIQLDNQNVHDIVVPGGFTLFNVSNDISCDKGERTRFRSDVLSFNEMSERFNQGISINGRMPLGLFNSMFNFRGPWHIDAQATKSLSLDGWFVTLYKMQIAKTPLVLCEEVKQAVPSSWDAAALANFIVKYGTHIVLSVKMGGKDAIYIRQQASSHLSPLEVQKYLKKIGDQKFRESKEPKEILNKEVTSVPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLATVPKNLQPYWNTSSSNEAPVWKEPDEKNDRWFEPVQWKGFAHVATIPMEIEPHSKGTACAYIVTGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNITEMTKGAQDLPGHWLVTGAKLDVENGKISLGVKYSLLHY

SEQ ID NO: 987 - protein, 607 aa, Huperzia carinata
MDKRTVVYPTTREKGLEAVRALGRGYDVTLDLKLGYCKGSPKSCLIQLDNQNVHDIVVPGGFTLFNVSKDISCDKGERTRFRSDVLNFHEMSERFNQGLSINARIPLGLFNSMFNYNGPWHVDAQTTKSLALDGWFITLYKMQITMTSLVLRDEVKQAVPSTWDAAALANFIEKYGTHIVLSVKMGGKDVIYIRQQAQSQLSPFEIQKNLKNIGDLKFHGSRESSYTLNKEVISASTSKNFVQHLPVSNTYDSISFVSQKDIEIIKQRRGGDKFVEAHEDWVTTISSAPEVISMTFVPITSLLSGVLGSGFLSHAINLYMRYKPPIEEIQHFLEFQIPRQWTPGYDLPLGPPRKEPLGPALQFSFLGPKLRISTNQVTVGHKPVTGLRLCLGGKKLNRLSLHLQHLSTLPKSLQPYWKTSLSSEARLWKEPEDQNSRWFEPVQWKGFSHVTTAPVELEANATDTAFAYVVIGAQLQVWELDSKKVLFLRLLFFKIQGCSIRRSAWDHMPSLSQMSQKSGILSQLGLSSTSMSSNKHAMSTPFVQNSAVFPGGPPAPAPNAKLLKFVNITEMTKGAQDLPGHWLVTGAKLDVENGKISLGVKYSLLHY

SEQ ID NO: 988 - protein, 604 aa, Huperzia carriata (Solomon Islands)
MDKKAVSNSTVEAKALEAVGALGRGYDVTLDLKLSYCKGSPESCLIQLDKQHLHDIVVPGGFTLFNISKDITCDKGERTRFRSDVLTFHEMSERFNQGLSINARIPLGLFNSMFNFRGPWHIDAQATKSLSLDGWFVTLYRMQIAKTPLVLCDEVKQAVPSSWDAAALANFIVKYGTHIVLSVKMGGKDVIYIRQQASSHLSPLEVQKYLKKIGDQRFRESREPKDTINKEATSTPTSMNLAQHLQIAKTYNSISFVSKKDIEIIKQRRGGSDFVKFHEEWLTTVSSAPEVISMTFVPIASLLNGVVGSGYLSHAINLYIRYKPPIEEIQQFLEFQIPRQWTPGYDLPLGPQRKEPLGPALQFSFLGPKLHVSTNQVSVGLRPVTGLRLYLGGKKFNRLSLHLQHLATLPKTLQPYWKTSLSGEARLWKEPEEQNSRWFEPVQWKGFSHVTTAPIELEPCATDTAFAYVVIGAQLQVWELDSKKVLFLRLLFLKIHGCSVRRSAWDHMPSLSQKSGILSQLGLSSTSMSSNKHPMSTPFVQNSAVFPGGPPAPAPNAKLLKFVNITEMTKGAEDVPGHWLVTGAKLDVENGKISLGVKYSLLHY

SEQ ID NO: 989 - protein, 603 aa, Huperzia nummulariifolia (Blume)
MDKRTVVYPTTREKGLDAVRALGRGYDVTLDLKLGYCKGSSKSCLIQLDNQNVHDIVVPGGFTLFNVSKDISCDKGERTRFRSDVLTFHEMSERFNQGLSINARIPLGLFNSMFNFRGPWHIDAQATKSLSLDGWFVTLYKMQIAKTPLVLCDEVKQAVPSSWDAAALANFIVKYGTHIVLSVKMGGKDAIYIRQQASSHVSPLEVQKYLKKIGDQKFRESKEPKEILNKEVTSATTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSVHLQHLSTLPKSLQPYWKTSLSSEARLWKEPEDQNSRWFEPVQWKGFSHVTTAPVELEANATDTAFAYVVIGAQLQVWELDSKKVLFLRLLFLKIHGCSIRRSAWDHMPTLSQKSGLLSQLGLSTSMSSNQHAISTPFVQNSAVFPGGPPAPAPNAKLLKFVNITEMTKGAEDIPGHWLVTGAKLDVENGKISLGVKYSLLHY

SEQ ID NO: 990 - protein, 604 aa, Huperzia phlegmaria
MDKRTVVYLTTREKGLEAVRALGRGYDVTLDLKLGYCKGSPKSCLIQLDNQNVHDIVVPGGFTLSNVSKDISCDKGERTRFRSDVLSFNEMSERFNQGLSINARIPLGLFNSMFNYNGPWHVDAQTTKSLALDGWFITLYKMQITTTSLVLRDEVKQAVPSTWDAAALANFIEKYGTHIVLSVKMGGKDAIYIRQQAHSQLSPFEIQKNLKKIGDLKFHGSRESNYTLNKEVISASTSKNFAQHLPISNTYDSISFVSQKDIEIIKQRRGGDKFVEAHEDWITTISSAPEVISMTFVPITSLLSGVLGSGFLSHAINLYMRYKPPIEEIQHFLEFQIPRQWTPGYDLPLGPPRKEPLGPALQFSFLGPKLHISTNEVTVGHRPVTGLRLCLGGKKFNRLSLHLQHLATVPKNLQPYWNTSSSNEAPVWKEPDEKNDRWFEPVQWKGFAHVTTIPMEIEPHSKGTACAYIVTGAQLQVWELETKKVLFLRLLFSKIHGCSIRRSIWDHVASSFPQKPALFSQLGLSTSMSSNQQAMPTPFSLNSAVFPGGPPAPAPNAKLLKFVNTTEMTKGAQDLPGHWLVTGAKLDVENGKISLGVKYSLLHY

SEQ ID NO: 991 - protein, 463 aa, Huperzia carriata (Solomon Islands)
MQITTTSLVLRDEVKQAVPSTWDAAALANFIEKYGTHIVLSVKMGGKDVIYIRQQAQSQLSPFEIQKNLKKIGDLKFQGSRESSYTLNKEVISASTSKNFVQHLPVSNTYDSISFVSQKDIEIIKQRRGGDKFVEAHEDWVTTISSAPEVISMTFVPITSLLSGVLGSGFLSHAINLYMRYKPPIEEMQHFLEFQIPRQWTPGYDLPLGPPRKEPLGPALQFSFLGPKLHISTNQVTVGHRPVTGLRLCLGGKKFNRLSLHLQHLATVPKNLQAYWNTSSSNEAPVWKEPDEKNDRWFEPVQWKGFSHVTTIPMEIEPHSKGAACAFIVTGAQLQVWELETKKVLFLRVLFSKIHGCSIRRSIWDHVASSFPQKPALFSQLGLSTSMSSNQQAMPTPFSLNSAVFPDGPPAPAPNAKLLKFVNTTEMTKGAKDLPGHWLVTGAKLDVENGKISLGVKYSLLHY

SEQ ID NO: 992 - protein, 603 aa, Huperzia nummulariifolia (Blume)
MDKKAVSNSTVEAKALEAVGALGRGYDVTLDLKLSYCKGSPESCLIQLDKQHLHDIVVPGGFTLFNISKDITCDKGERTRFRSDVLTFHEMSERFNQGLSINARIPLGLFNSMFNFRGPWHIDAQATKSLSLDGWFVTLYKMQIAKTPLVLCDEVKQAVPSSWDAAALANFIVKYGTHIVLSVKMGGKDAIYIRQQASSHVSPLEVQKYLKKIGDQKFRESKEPKEILNKEVTSATTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSVHLQHLSTLPKSLQPYWKTSLSSEARLWKEPEDQNSRWFEPVQWKGFSHVTTAPVELEANATDTAFAYVVIGAQLQVWELDSKKVLFLRLLFLKIHGCSIRRSAWDHMPTLSQKSGLLSQLGLSTSMSSNQHAISTPFVQNSAVFPGGPPAPAPNAKLLKFVNITEMTKGAEDIPGHWLVTGAKLDVENGKISLGVKYSLLHY

SEQ ID NO: 993 - protein, 579 aa, Huperzia nummarifolia
MDKRTVVYPTTRDKGLEAVRALGRGYDVTLDLKLGYCKGSPKSCLIQLDNQNVHDIVVPGGFTLFNVSKDISCDKGERTRFRSDVLSFNEMSERPWHVDAQTTKSLALDGWFITLYKMQITTTSLVLRDEVKQAVPSTWDAAALANFIEKYGTHIVLSVKMGGKDVIYIRQQAQSQLSPFEIQKNLKKIGDLKFHGSRESNYTLNKEVISASTSKNFVQHLPVSNTYDSISFVSQKDIEIIKQRRGGDKFVEAHEDWVTTISSAPEVISMTFVPITSLLSGVLGSGFLSHAINLYMRYKPPIEEIQHFLEFQIPRQWTPGYDLPLGPPRKEPLGPALQFSFLGPKLHISTNQVAVGHRPVTGLRLCLGGKKFNRLSLHLQHLSTLPKSLQPYWKTSLSSEARLWKEPEDQNSRWFEPVQWKGFSHVTTAPVELEANATDTAFAYVVIGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNITEMTKGAQDLPGHWLVTGAKLDVENGKISLGVKYSLLHY

SEQ ID NO: 994 - protein, 607 aa, Huperzia nummarifolia
MDKKAVSNSTVEAKALEAVGALGRGYDRGYDVTLDLKLSYCKGSPESCLIQLDKQHLHDIVVPGGFTLFNISKDITCDKGERTRFRSDVLTFHEMSERFNQGLSINARIPLGLFNSMFNFRGPWHIDAQATKSLSLDGWFVTLYKMQIAKTPLVLCEEVKQAVPSSWDAAALANFIVKYGTHIVLSVKMGGKDAIYIRQQASSHLSPLEVQKYLKKIGDQKFRESKEPKEILNKEVTSVPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQNSRWFEPVQWKGFSHVTTAPVELEANATDTAFAYVVIGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNITEMTKGAQDLPGHWLVTGAKLDVENGKISLGVKYSLLHY

SEQ ID NO: 995 - protein, 640 aa, Huperzia squarrosa
MDKRAVLNSTVQSKAIEAVGALGRGYDVTLDLKLGYCKGSPESCLIELDKQHFHDIVVPGDFTLLNVSKDITCDKGERTRFRSDVLSFHEMSERFNQGTSINGRMPLGLFNSMFNFRGPWHIDAQATKSLSLDGWFVTLYKMQIAKTPLVLCDEVKQAVPSSWDAAALASFIVKYGTHIVLSVKMGDIVLSVKMGGKDVIYIRQQASSNLSPLEVQKYLKKIGDQRFRESREPTDILNKEVTSAPTTMNLAQHLQFAKTYHSISLTSKKDIEIIMQRRGGNDFVEAHEGWLQTVSSAPEVISMTFVPIASLLNGVAGSGYLSHAINLYIRYKPPIEEIQQFLEFQIPRQWTPGYDLPLGPQRKEPLGPALQFSFLGPTPGYDLPLGPQRKEPLGPALQFSFLGPKLHISTNQVSVGLRPVTGLRLYLGGKKFNRLSLHLQHLATLPKTLQPYWKTSLSSEARLWKEPEEQNSRWFEPVQWKGFSHVTTAPVELEPCATDTAFAYVVIGAQLQVWELDSKKVLFLRLLFLKIHGCSVRRSAWDHMPSLSQKSGLLSQLGLSSTSMSSNKHAASTPFVQNSAVFPGGPPALAPNAKLLKFVNITEMTKGAEDVPGHWLVTGAKLDVENGKISLGVKYSLLHY

SEQ ID NO: 996 - protein, 463 aa, Huperzia squarrosa
MQITTTSLVLRDEVKQEVPSAWDAAALANFIEKYGTHIVLSVKMGGKDVIYIRQQALSQLSPFEIQKNLKKIGDLSFHGSRESNHTLNKEVISASTSKNFAQHLPISHTYNSISFVSHKDIEIIEQRRGGDKFVKAHEDWVTTISSAPEVISMTFVPITSLLGGVLGSGFLSHAINLYMRYKPPIEEIQHFLEFQIPRQWTPGYDLPLGPPRKEPLGPALQFSFLGPKLYISTNQVTVGHRPVTGLRLCLGGKKFNRLSLHLQHLATVPKNLQPYWNTSSSNEAPVWKDPEEKSDRWFEPVQWKGFSHVATVPVEIEPHSKGTACAYIVTGAQLQVWELETKKVLFLRLLFSKIHGCSIRRSIWDHVASSFSQKPALFSQLGLSTSMSSNQQAMPTPFSLNSAVFPGGPPAPAPNAKLLKFVNITEMTKGAEDVPGHWLVTGAKLDVENGKISLGVKYSLLHY

SEQ ID NO: 997 - protein, 326 aa, Huperzia nummulariifolia (Blume)
MDKKAVSNSTVEAKALEAVGALGRGYDVTLDLKLSYCKGSPESCLIQLDKQHLHDIVVPGGFTLFNISKDITCDKGERTRFRSDVLTFHEMSERFNQGLSINARIPLGLFNSMFNFRGPWHIDAQATKSLSLDGWFVTLYKMQIAKTPLVLCDEVKQAVPSSWDAAALANFIVKYGTHIVLSVKMGGKDAIYIRQQASSHVSPLEVQKYLKKIGDQKFRESKEPKEILNKEVTSATTTMNLAQHLQFAKTYHSISFTSKKDIEIIMQRRGGNDFVEAHEEWLPTVSSAPEVISMTFVPIASLLNGVAGSGYLSHAINLCNQLIHSI

SEQ ID NO: 998 - protein, 604 aa, Platycerium bifurcatum
MDKRTVVYPTTREKGLEAVRALGRGYDVTLDLKLGYCKGSPQSCLIQLDNQNVHDIVVPGGFTLFNVSNDISCDKGERTRFRSDVLSFNEMSERFNQGISINGRMPLGLFNSMFNFRGPWHIDAQATKSLSLDGWFVTLYKMQIAKTPLVLCEEVKQAVPSSWDAAALANFIVKYGTHIVLSVKMGGKDAIYIRQQASSHLSPLEVQKYLKKIGDQKFRESKEPKEILNKEVTSVPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLATVPKNLQPYWNTSSSNEAPVWKEPDEKNDRWFEPVQWKGFAHVATIPMEIEPHSKGTACAYIVTGAQLQVWELETKKVLFLRLLFSKIHGCSIRRSIWDHVASSFPQKPALFSQLGLSTSMSSNQQAMPTPFSLNSAVFPGGPPAPAPNAKLLKFVNTTEMTKGAKDLPGHWLVTGAKLDVENGKISLGVKYSLLHY

SEQ ID NO: 999 - protein, 399 aa, Huperzia nummulariifolia (Blume)
MDKKAVSNSTVEAKALEAVGALGRGYDVTLDLKLSYCKGSPESCLIQLDKQHLHDIVVPGGFTLFNISKDITCDKGERTRFRSDVLTFHEMSERFNQGLSINARIPLGLFNSMFNFRGPWHIDAQATKSLSLDGWFVTLYKMQIAKTPLVLCDEVKQAVPSSWDAAALANFIVKYGTHIVLSVKMGGKDAIYIRQQASSHVSPLEVQKYLKKIGDQKFRESKEPKEILNKEVTSATTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRSALGTSKKRASGSCFAV

SEQ ID NO: 1000 - protein, 603 aa, Huperzia nummarifolia
MDKRTVVYPTTRDKGLEAVRALGRGYDVTLDLKLGYCKGSPKSCLIQLDNQNVHDIVVPGGFTLFNVSKDISCDKGERTRFRSDVLTFHEMSERFNQGLSINARIPLGLFNSMFNFRGPWHIDAQATKSLSLDGWFVTLYKMQIAKTPLVLCEEVKQAVPSSWDAAALANFIVKYGTHIVLSVKMGGKDAIYIRQQASSHLSPLEVQKYLKKIGDQKFRESKEPKEILNKEVTSVPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQNSRWFEPVQWKGFSHVTTAPVELEANATDTAFAYVVIGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNITEMTKGAQDLPGHWLVTGAKLDVENGKISLGVKYSLLHY

SEQ ID NO: 1001 - protein, 416 aa, Selaginella biformis
MAQEKTSAYFTASEAVQALGKGFDTTLDLRLAGCKGPSGRLVELDETNREDLFVQDRVVIPNVSKDIRCDKGEFTHFRSEVLTFHQMSERFNQELSITGKMPLGLFNTMYSFNGPWQADASTTKSLALDGRFITSYKLQIVKSPLVLREEVKKAVPSSWDPAALAKFIDTYGTHIIVSVKVGGKDVVYVRQHQSSPLSPTELQKFIKRIADQKFAETNGSVSDSGNIKDKMQTPDLLAGSNHAHRLQLETFASSGGFTAKEDVEIIFRRRGGSNLLKSHNEWLKTVADAPDVISMTFVPITSLLNGVLGSGFLSHAVNLYLRHKPPIEDLQYFLEFQIPRQWSPGFDLPLGPQRKEPVCPAMQFSLMGPKLYVSTTQVSTKCFFSCFLCQLLLVSGDNRKKTCYRTTAFLGRQEMQ

SEQ ID NO: 1002 - protein, 604 aa, Huperzia phlegmaria
MDKRTVVYLTTREKGLEAVRALGRGYDVTLDLKLGYCKGSPKSCLIQLDNQNVHDIVVPGGFTLSNVSKDISCDKGERTRFRSDVLSFNEMSERFNQGLSINARIPLGLFNSMFNFRGPWHIDAQATKSLSLDGWFVTLYKMQIAKTPLVLCDEVKQAVPSSWDAAALANFIVKYGTHIVLSVKMGGKDAIYIRQQAHSQLSPFEIQKNLKKIGDLKFHGSRESNYTLNKEVISASTSKNFARHLPISNTYDSISFVSQKDIEIIKQRRGGDKFVEAHEDWITTISSAPEVISMTFVPITSLLSGVLGSGFLSHAINLYMRYKPPIEEIQHFLEFQIPRQWTPGYDLPLGPPRKEPLGPALQFSFLGPKLHISTNEVTVGHRPVTGLRLCLGGKKFNRLSLHLQHLATVPKNLQPYWNTSSSNEAPVWKEPDEKNDRWFEPVQWKGFAHVTTIPMEIEPHSKGTACAYIVTGAQLQVWELETKKVLFLRLLFSKIHGCSIRRSIWDHVASSFPQKPALFSQLGLSTSMSSNQQAMPTPFSLNSAVFPGGPPAPAPNAKLLKFVNTTEMTKGAQDLPGHWLVTGAKLDVENGKISLGVKYSLLHY

SEQ ID NO: 1003 - protein, 603 aa, Huperzia phlegmaria
MDKRTVVYLTTREKGLEAVRALGRGYDVTLDLKLGYCKGSPKSCLIQLDNQNVHDIVVPGGFTLSNVSKDISCDKGERTRFRSDVLSFNEMSERFNQGLSINARIPLGLFNSMFNYNGPWHVDAQTTKSLALDGWFITLYKMQITTTSLVLRDEVKQAVPSTWDAAALANFIEKYGTHIVLSVKMGGKDAIYIRQQASSHLSPLEVQKYLKKIGDQKFREFKEPKEILNKEVTSAPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQNSRWFEPVQWKGFSHVTTAPVELEANATDTAFAYVVIGAQLQVWELDSKKVLFLRLLFLKIHGCSIRRSAWDHMPTLSQKSGLLSQLGLSTSMSSNQHAISTPFVQNSAVFPGGPPAPAPNAKLLKFVNITEMTKGAQDLPGHWLVTGAKLDVENGKISLGVKYSLLHY

SEQ ID NO: 1004 - protein, 604 aa, Huperzia carinata
MDKRTVVYPTTREKGLEAVRALGRGYDVTLDLKLGYCKGSPKSCLIQLDNQNVHDIVVPGGFTLFNVSKDISCDKGERTRFRSDVLNFHEMSERFNQGLSINARIPLGLFNSMFNYNGPWHVDAQTTKSLALDGWFITLYKMQITMTSLVLRDEVKQAVPSTWDAAALANFIEKYGTHIVLSVKMGGKDAIYIRQQASSQLSPLEVQKYLKKIGDQRFRESREPKDIINKEATSTPTSMNLAQHLQIAKTYHSISFVSKKDIEIIKQRRGGSDFVKSHEEWLTTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLATVPKNLQAYWNTSSSNEAPVWKEPDEKNDRWFEPVQWKGFSHVTTIPMEIEPHSKGAACAFIVTGAQLQVWELETKKVLFLRVLFSKIHGCSIRRSIWDHVASSFPQKPALFSQLGLSTSMSSNQQAMPTPFSLNSAVFPDGPPAPAPNAKLLKFVNTTEMTKGAKDLPGHWLVTGAKLDVENGKISLGVKYSLLHY

SEQ ID NO: 1005 - protein, 513 aa, Huperzia carriata (Philippines)
MSERFNQGLSINARIPLGLFNSMFNFRGPWHIDAQATKSLSLDGWFVTLYRMQITKTPLVLCDEVKQAVPSSWDAAALANFIVKYGTHIVLSVKMGGKDVIYIRQEAQSQLSPFEIQKNLKNIGDLKFHGSRESSYTLNKEVISASTSKNFVEHLPVSNTYDSISFVSQKDIEIIKQRRGGDKFVEAHEDWVTTISSAPEVISMTFVPITSLLSGVLGSGFLSHAINLYMRYKPPIEEIQHFLEFQIPRQWTPGYDLPLGPPRKEPLGPALQFSFLGPKLRISTNQVTVGHKPVTGLRLCLGGKKLNRLSLHLQHLSTLPKSLQPYWKTSLSSEARLWKEPEDQSSRWFEPVQWKGFSHVTTAPVELEANATDTAFAYVVIGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNTTEMTKGAKDLPGHWLVTGAKLDVEDGKISLGVKYSLLHY

SEQ ID NO: 1006 - protein, 435 aa, Huperzia carriata (Philippines)
MDKKAVSNSTVEAKALEAVGALGRGYDVTLDLKLSYCKGSPESCLLQLDKQHLHDIVVPGGFTLFNISKDITCDKGERTRFRSDVLSFNEMSERFNQGLSINARIPLGLFNSMFNFRGPWHIDAQATKSLSLDGWFVTLYRMQITKTPLVLCDEVKQAVPSSWDAAALANFIVKYGTHIVLSVKMGGKDAIYIRQQASSQLSPLEVQKYLKKIGDQRFRESREPKDIINKEATSTPTSMNLAQHLQIAKTYNSISFVSKKDIEIIKQRRGGSDFVKSHEEWLTTVSSAPEVISMTFVPIASLLNGVAGSGYLSHAINLYIRYKPPIEEIQQFLEFQIPRQWTPGYDLPLKKFNRLSLHLQHLATLPKTLQPYWKTSLSGEARLWKEPEEQNSRWFEPVQWKGFSHVTTAPIELEPCATDTAFAYVVIGAQLQVWE

SEQ ID NO: 1007 - protein, 604 aa, Huperzia salvinioides
MDKKAVSNSTVEAKALEAVGALGRGYDVTLDLKLSYCKGSPESCLIQLDKQHLHDIVVPGGFTLFNISKDITCDKGERTRFRSDVLTFHEMSERFNQGLSINARIPLGLFNSMFNFRGPWHIDAQATKSLSLDGWFVTLYKMQIAKTPLVLCDEVKQAVPSSWDAAALANFIVKYGTHIVLSVKMGGKDAIYIRQQASSHVSPLEVQKYLKKIGDQRFRESREPKDIINKEATSTPTSMNLAQHLQIAKTYHSISFVSKKDIEIIKQRRGGSDFVKSHEQWLTTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSVHLQHLSTLPKSLQPYWKTSLSSEARLWKEPEDQNSRWFEPVQWKGFSHVTTAPVELEANATDTAFAYVVIGAQLQVWELDSKKVLFLRLLFLKIHGCSVRRSAWDHMPSLSQKSGILSQLGLSSTSMSSNKHAVSTPFVQNSAVFAGGPPAPAPNAKLLKFVNITEMTKGAQDLPGHWLVTGAKLDVENGKISLGVKYSLLHY

SEQ ID NO: 1008 - protein, 512 aa, Selaginella pallescens
MSERFNQELSITGKMPLGLFNHMYSFNGPWQADASSTKSLALDGRFITSYKLQIAKSPLVLRDEVKRAVPASWDPAALAKFIDTYGTHVIVSIKVGGKDVLYVRQHQSSPLSTTELQKLIKRFADQRFADTNGSVSDPRNVKNKMQPDLLAGRLPIESDTITAKEDEIIFRRRGGSNLLRNHNEWLKTVAEAPDVISMTFVPITSLLNGVLGSGFLSHAVNLYLRHKPPIEDLQYFLEFQIPRQWSPGFDLPLGPQRKEPVCPAMQFSLMGPKLYVSTAQVTIGRRPVTGLRLFLEGKKCNRLGIHLQHLSSLPKILQPHWDSNVPIGPPVWKGPEEQDSKWFEPVQWKSFSHVSTQPVEFLEESYVGQTSGTYIVTGGQLGVWDFGMKKVLFLRLLFSRVPGCAIRRTIWDHSPTTSQKSGLFSQLGLSSTFSGAQKAAAAKPAPVVLNSAVYPGGPPVPVPSRKLLKYVDITEMTKGAHDMPGHWIVTGAKLDVDRGRIALRLKYSLLHY

SEQ ID NO: 1009 - protein, 603 aa, Huperzia nummulariifolia
MDKRTVVYPTTREKGLEAVRALGRGYDVTLDLKLGYCKGSPQSCLIQLDNQNVHDIVVPGGFTLFNVSNDISCDKGERTRFRSDVLSFNEMSERFNQGISINGRMPLGLFNSMFNFRGPWHIDAQATKSLSLDGWFVTLYKMQIAKTPLVLCEEVKQAVPSSWDAAALANFIVKYGTHIVLSVKMGGKDAIYIRQQASSHLSPLEVQKYLKKIGDQKFRESKEPKEILNKEVTSVPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQHFLEFQIPRQWTPGYDLPLGPQRKEPLGPALQFSFLGPKLHISTNEVSVGLRPVTGLRLYLGGKKFNRLSLHLQHLATVPKNLQPYWNTSSSNEAPVWKEPDEKNDRWFEPVQWKGFAHVATIPMEIEPHSKGTACAYIVTGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNITEMTKGAQDLPGHWLVTGAKLDVENGKISLGVKYSLLHY

SEQ ID NO: 1010 - protein, 603 aa, Huperzia salvinioides
MDKRTVVYPTTREKGVDAVRALGRGYDVTLDLKLGYCKGSSKSCLIQLDNQNVHDIVVPGGFTLFNVSKDISCDKGERTRFRSDVLTFHEMSERFNQGLSINARIPLGLFNSMFNFRGPWHIDAQATKSLSLDGWFVTLYKMQIAKTPLVLCDEVKQAVPSSWDAAALANFIVKYGTHIVLSVKMGGKDAIYIRQQASSHVSPLEVQKYLKKIGDQKFRESKEPKEILNKEVTSATTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSVHLQHLSTLPKSLQPYWKTSLSSEARLWKEPEDQNSRWFEPVQWKGFSHVTTAPVELEANATDTAFAYVVIGAQLQVWELDSKKVLFLRLLFLKIHGCSIRRSAWDHMPTLSQKSGLLSQLGLSTSMSSNQHAISTPFVQNSAVFPGGPPAPAPNAKLLKFVNITEMTKGAQDLPGHWLVTGAKLDVENGKISLGVKYSLLHY

SEQ ID NO: 1011 - protein, 604 aa, Huperzia phlegmaria
MDKKAVSNSTVEAKALEAVGALGRGYDVTLDLKLSYCKGSPESCLIQLDKQNLHDIVVPGGFTLFNISKDITCDKGERTRFRSDVLTFHEMSERFNQGLSINARIPLGLFNSMFNFRGPWHIDAQATKSLSLDGWFVTLYKMQIAKTPLVLCDEVKQAVPSSWDAAALANFIVKYGTHIVLSVKMGGKDAIYIRQQASSHLSPLEVQKYLKKIGDQKFREFKEPKEILNKEVTSAPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVTVGHRPVTGLRLCLGGKKFNRLSLHLQHLATVPKNLQPYWNTSSSNEAPVWKEPDEKNDRWFEPVQWKGFAHVTTIPMEIEPHSKGTACAYIVTGAQLQVWELETKKVLFLRLLFSKIHGCSIRRSIWDHVASSFPQKPALFSQLGLSTSMSSNQQAMPTPFSLNSAVFPGGPPAPAPNAKLLKFVNTTEMTKGAQDLPGHWLVTGAKLDVENGKISLGVKYSLLHY

SEQ ID NO: 1012 - protein, 513 aa, Huperzia carriata (Philippines)
MSERFNQGLSINARIPLGLFNSMFNFRGPWHIDAQATKSLSLDGWFVTLYNMQVSRTSLVLCDEVKQAVPSSWDAAALASFIEKYGTHIVLSVKMGGKDAIYIRQQASSQLSPLEVQKYLKKIGDQKFRESKEPKEILNKEVTSAPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQSSRWFEPVQWKGFSHVTTAPVELEANATDTAFAYVVIGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNTTEMTKGAKDLPGHWLVTGAKLDVENGKISLGVKYSLLHY

SEQ ID NO: 1013 - protein, 604 aa, Huperzia phlegmaria
MDKKAVSNSTVEAKALEAVGALGRGYDVTLDLKLSYCKGSPESCLIQLDKQNLHDIVVPGGFTLFNISKDITCDKGERTRFRSDVLTFHEMSERFNQGLSINARIPLGLFNSMFNFRGPWHIDAQATKSLSLDGWFVTLYKMQIAKTPLVLCDEVKQAVPSSWDAAALANFIVKYGTHIVLSVKMGGKDAIYIRQQAHSQLSPFEIQKNLKKIGDLKFHGSRESNYTLNKEVISASTSKNFAQHLPISNTYDSISFVSQKDIEIIKQRRGGDKFVEAHEDWITTISSAPEVISMTFVPITSLLSGVLGSGFLSHAINLYMRYKPPIEEIQHFLEFQIPRQWTPGYDLPLGPPRKEPLGPALQFSFLGPKLHISTNEVTVGHRPVTGLRLCLGGKKFNRLSLHLQHLATVPKNLQPYWNTSSSNEAPVWKEPDEKNDRWFEPVQWKGFAHVTTIPMEIEPHSKGTACAYIVTGAQLQVWELETKKVLFLRLLFSKIHGCSIRRSIWDHVASSFPQKPALFSQLGLSTSMSSNQQAMPTPFSLNSAVFPGGPPAPAPNAKLLKFVNTTEMTKGAQDLPGHWLVTGAKLDVENGKISLGVKYSLLHY

SEQ ID NO: 1014 - protein, 513 aa, Huperzia carriata (Solomon Islands)
MSERFNQGLSINARIPLGLFNSMFNFRGPWHIDAQATKSLSLDGWFVTLYRMQIAKTPLVLCDEVKQAVPSSWDAAALANFIVKYGTHIVLSVKMGGKDVIYIRQQASSHLSPLEVQKYLKKIGDQKFRESKEPKEILNKEVTSAPTTMNLAQHLQFAKTYHSISFTSKKDIEIIMQRRGGNDFVEAHEEWLPTVSSAPEVISMTFVPIASLLNGVSGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQNSRWFEPVQWKGFSHVTTAPVELEGNATDTAFAYVVIGAQLQVWELDSKKVLFLRLLFLKIHGCSVRRSAWDHMPSLSQKSGLLSQLGLSTSMSSNQHAISTPFVQNSAVFPGGPPAPAPNAKLLKFVNITEMTKGAEDVPGHWLVTGAKLDVENGKISLGVKYSLLHY

SEQ ID NO: 1015 - protein, 416 aa, Selaginella biformis
MAQEKTSAYFTASEAVQALGKGFDTTLDLRLAGCKGPSGRLVELDETNREDLFVQDRVVIPNVSKDIRCDKGEFTHFRSEVLTFHQMSERFNQELSITGKMPLGLFNTMYSFNGPWQADASTTKSLALDGRFITSYKLQIVKSPLVLREEVKKAVPSSWDPAALAKFIDTYGTHIIVSVKVGGKDVVYVRQHQSSPLSPTELQKFIKRIADQKFAETNGSVSDSGNIKDKMQTPDLLAGSNHAHRLQLETFASSGGFTAKEDVEIIFRRRGGSNLLKSHNEWLKTVADAPDVISMTFVPITSLLNGVLGSGFLSHAVNLYLRHKPPIEDLQYFLEFQIPRQWSPGFDLPLGPQRKEPVCPAMQFSLMGPKLYVSTTQVSTKCFFSCFLYQLLLVSGDNRKKTCYRTTAFLGRQEMQ

SEQ ID NO: 1016 - protein, 492 aa, Platycerium bifurcatum
MFNYNGPWHVDAQTTKSLALDGWFITLYKMQITTTSLVLRDEVKQAVPSTWDAAALANFIEKYGTHIVLSVKMGGKDVIYIRQQAQSQLSPFEIQKNLKKIGDLKFHGSRESNYTLNKEVISASTSKNFVQHLPVSNTYDSISFVSQKDIEIIKQRRGGDKFVEAHEDWVTTISSAPEVISMTFVPITSLLSGVLGSGFLSHAINLYMRYKPPIEEIQHFLEFQIPRQWTPGYDLPLGPPRKEPLGPALQFSFLGPKLHISTNQVAVGHRPVTGLRLCLGGKKFNRLSLHLQHLATVPKNLQPYWNTSSSNEAPVWKEPDEKNDRWFEPVQWKGFAHVATIPMEIEPHSKGTACAYIVTGAQLQVWELETKKVLFLRLLFSKIHGCSIRRSIWDHVASSFPQKPALFSQLGLSTSMSSNQQAMPTPFSLNSAVFPGGPPAPAPNAKLLKFVNTTEMTKGAKDLPGHWLVTGAKLDVENGKISLGVKYSLLHY

SEQ ID NO: 1017 - protein, 580 aa, Huperzia nummarifolia
MDKRTVVYPTTRDKGLEAVRALGRGYDVTLDLKLGYCKGSPKSCLIQLDNQNVHDIVVPGGFTLFNVSKDISCDKGERTRFRSDVLSFNEMSERPWHVDAQTTKSLALDGWFITLYKMQITTTSLVLRDEVKQAVPSTWDAAALANFIEKYGTHIVLSVKMGGKDVIYIRQQAQSQLSPFEIQKNLKKIGDLKFHGSRESNYTLNKEVISASTSKNFVQHLPVSNTYDSISFVSQKDIEIIKQRRGGDKFVEAHEDWVTTISSAPEVISMTFVPITSLLSGVLGSGFLSHAINLYMRYKPPIEEIQHFLEFQIPRQWTPGYDLPLGPPRKEPLGPALQFSFLGPKLHISTNQVAVGHRPVTGLRLCLGGKKFNRLSLHLQHLATVPKNLQPYWNTSSSNEAPVWKEPDEKDDRWFEPVQWKGFAHVATIPMEIEPHSKGTACAYIVTGAQLQVWELETKKVLFLRLLFSKIHGCSIRRSIWDHVASSFPQKPALFSQLGLSTSMSSNQQAMPTPFSLNSAVFPGGPPAPAPNAKLLKFVNTTEMTKGAKDLPGHWLVTGAKLDVENGKISLGVKYSLLHY

SEQ ID NO: 1018 - protein, 514 aa, Huperzia squarrosa
MSERFNQGTSINGRMPLGLFNSMFNFRGPWHIDAQATKSLSLDGWFVTLYKMQIAKTPLVLCDEVKQAVPSSWDAAALASFIVKYGTHIVLSVKMGGKDVIYIRQQASSNLSPLEVQKYLKKIGDQRFRESREPTDILNKEVTSAPTTMNLAQHLQFAKTYHSISLTSKKDIEIIMQRRGGNDFVEAHEGWLQTVSSAPEVISMTFVPIASLLNGVAGSGYLSHAINLYIRYKPPIEEIQQFLEFQIPRQWTPGYDLPLGPQRKEPLGPALQFSFLGPKLHISTNQVSVGLRPVTGLRLYLGGKKFNRLSLHLQHLATLPKTLQPYWKTSLSSEARLWKEPEEQNSRWFEPVQWKGFSHVTTAPVELEPCATDTAFAYVVIGAQLQVWELDSKKVLFLRLLFLKIHGCSVRRSAWDHMPSLSQKSGLLSQLGLSSTSMSSNKHAASTPFVQNSAVFPGGPPALAPNAKLLKFVNITEMTKGAEDVPGHWLVTGAKLDVENGKISLGVKYSLLHY

SEQ ID NO: 1019 - protein, 604 aa, Huperzia phlegmaria
MDKRAVLNSTVQSKAIEAVGALGRGYDVTLDLKLGYCKGSPESCLIELDKQHFHDIVVPGDFTLFNVSKDITCDKGERTRFRSDVLTFHEMSERFNQGLSINARIPLGLFNSMFNFRGPWHIDAQATKSLSLDGWFVTLYKMQIAKTPLVLCDEVKQAVPSSWDAAALANFIVKYGTHIVLSVKMGGKDAIYIRQQASSHLSPLEVQKYLKKIGDQKFREFKEPKEILNKEVTSAPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVTVGHRPVTGLRLCLGGKKFNRLSLHLQHLATVPKNLQPYWNTSSSNEAPVWKEPDEKNDRWFEPVQWKGFAHVTTIPMEIEPHSKGTACAYIVTGAQLQVWELETKKVLFLRLLFSKIHGCSIRRSIWDHVASSFPQKPALFSQLGLSTSMSSNQQAMPTPFSLNSAVFPGGPPAPAPNAKLLKFVNTTEMTKGAQDLPGHWLVTGAKLDVENGKISLGVKYSLLHY

SEQ ID NO: 1020 - protein, 603 aa, Huperzia nummulariifolia
MDKKAVSNSTVEAKALEAVGALGRGYDVTLDLKLSYCKGSPESCLIQLDKQHLHDIVVPGGFTLFNISKDITCDKGERTRFRSDVLSFNEMSERFNQGISINGRMPLGLFNSMFNFRGPWHIDAQATKSLSLDGWFVTLYKMQIAKTPLVLCEEVKQAVPSSWDAAALANFIVKYGTHIVLSVKMGGKDAIYIRQQASSHLSPLEVQKYLKKIGDQKFRESKEPKEILNKEVTSVPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQHFLEFQIPRQWTPGYDLPLGPQRKEPLGPALQFSFLGPKLHISTNEVSVGLRPVTGLRLYLGGKKFNRLSLHLQHLATVPKNLQPYWNTSSSNEAPVWKEPDEKNDRWFEPVQWKGFAHVATIPMEIEPHSKGTACAYIVTGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNITEMTKGAQDLPGHWLVTGAKLDVENGKISLGVKYSLLHY

SEQ ID NO: 1021 - protein, 604 aa, Huperzia nummulariifolia
MDKRTVVYPTTREKGLEAVRALGRGYDVTLDLKLGYCKGSPQSCLIQLDNQNVHDIVVPGGFTLFNVSNDISCDKGERTRFRSDVLSFNEMSERFNQGISINGRMPLGLFNSMFNYNGPWHVDAQTTKSLALDGWFITLYKMQITTTSLVLRDEVKQAVPSTWDAAALANFIEKYGTHIVLSVKMGGKDAIYIRQQAQSQLSPFEIQKNLKKIGDLKFHGSRESNYTLNKEVISASTSKNFVQHLPVSNTYDSISFVSQKDIEIIKQRRGGDKFVEAHEDWVTTISSAPEVISMTFVPITSLLSGVLGSGFLSHAINLYMRYKPPIEEIQHFLEFQIPRQWTPGYDLPLGPPRKEPLGPALQFSFLGPKLHISTNQVAVGHRPVTGLRLCLGGKKFNRLSLHLQHLATVPKNLQPYWNTSSSNEAPVWKEPDEKNDRWFEPVQWKGFAHVATIPMEIEPHSKGTACAYIVTGAQLQVWELETKKVLFLRLLFSKIHGCSIRRSIWDHVASSFPQKPALFSQLGLSTSMSSNQQAMPTPFSLNSAVFPGGPPAPAPNAKLLKFVNTTEMTKGAKDLPGHWLVTGAKLDVENGKISLGVKYSLLHY

SEQ ID NO: 1022 - protein, 603 aa, Huperzia carriata (Solomon Islands)
MDKRTVVYPTTREKGLEAVRALGRGYDVTLDLKLGYCKGSPKSCLIQLDNQNVHDIVVPGGFTLFNVSKDISCDKGERTRFRSDVLTFHEMSERFNQGLSINARIPLGLFNSMFNFRGPWHIDAQATKSLSLDGWFVTLYRMQIAKTPLVLCDEVKQAVPSSWDAAALANFIVKYGTHIVLSVKMGGKDVIYIRQQASSHLSPLEVQKYLKKIGDQKFRESKEPKEILNKEVTSAPTTMNLAQHLQFAKTYHSISFTSKKDIEIIMQRRGGNDFVEAHEEWLPTVSSAPEVISMTFVPIASLLNGVSGSGYLSHAINLYIRYKPPIEEIQQFLEFQIPRQWTPGYDLPLGPQRKEPLGPALQFSFLGPKLHVSTNQVSVGLRPVTGLRLYLGGKKFNRLSLHLQHLSTLPKSLQPYWKTSLSSEARLWKEPEDQNSRWFEPVQWKGFSHVTTAPVELEGNATDTAFAYVVIGAQLQVWELDSKKVLFLRLLFLKIHGCSVRRSAWDHMPSLSQKSGLLSQLGLSTSMSSNQHAISTPFVQNSAVFPGGPPAPAPNAKLLKFVNITEMTKGAEDVPGHWLVTGAKLDVENGKISLGVKYSLLHY

SEQ ID NO: 1023 - protein, 651 aa, Huperzia tetratoides
MDKTAVLNSTLQSKAIEALGALGRGYDVTLDLKLGYCKGSPESCLIELEQHFHDIVVPGDFTLFNVSKDITCDKGERTRFRSDVLSFHEMSERFNQGLSINARIPLGLFNSMFNFRGPWHIDAQATKSLSLDGWFVTLYKMQVSRTSMVLCDEVKQAVPSSWDAAALASFIEKYGTHIVLSVKMGGKDAIYIRQQASSHLSPLEVQKYLKKIGDQRFRESREPKDILNKEVRSAPTTMNLAQHLQFAKTYHSISFMSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKRFNRLSLHLQHLATLPKSLQPYWKTSLSSEARLWKQPYWKTSLSSEARLWKEPEDQSSRWFEPVQWKGFSHVTTAPVELEANATDTSFAYVVIGAQLQVWELDSKKVLFLRLLFLKIHGCSIRRSAWDHMPSLSQKSGLLSQLGLSTSMSSNQHAISTPFVQNSAVFPGGPPAPAPNAKLLKFVNITEMTKGAQDLPGHWLVTGAAPAPNAKLLKFVNITEMTKGAQDLPGHWLVTGAKLDVDNGKISLGVKYSLLHY

SEQ ID NO: 1024 - protein, 607 aa, Huperzia carinata
MDKRTVVYPTTREKGLEAVRALGRGYDVTLDLKLGYCKGSPKSCLIQLDNQNVHDIVVPGGFTLFNVSKDISCDKGERTRFRSDVLNFHEMSERFNQGLSINARIPLGLFNSMFNYNGPWHVDAQTTKSLALDGWFITLYKMQITMTSLVLRDEVKQAVPSTWDAAALANFIEKYGTHIVLSVKMGGKDAIYIRQQASSQLSPLEVQKYLKKIGDQKFRESKEPKEILNKEVTSAPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQNSRWFEPVQWKGFSHVTTAPVELEANATDTAFAYVVIGAQLQVWELDSKKVLFLRLLFFKIQGCSIRRSAWDHMPSLSQMSQKSGILSQLGLSSTSMSSNKHAMSTPFVQNSAVFPGGPPAPAPNAKLLKFVNITEMTKGAQDLPGHWLVTGAKLDVENGKISLGVKYSLLHY

SEQ ID NO: 1025 - protein, 547 aa, Huperzia nummulariifolia (Blume)
MDKRTVVYPTTREKGLDAVRALGRGYDVTLDLKLGYCKGSSKSCLIQLDNQNVHDIVVPGGFTLFNVSKDISCDKGERNGRMPLGLFNSMFNYSGPWHVDAQTTKSLALDGWFITLYKMQITTTSLVLRDEVKQAVPSTWDAAALANFIEKYGTHRQQAQSQLSPFEIQKNLKKIGDLKFHGSRESNYTLNKEVVSASTSKNFAQHLPISNTYDSISFVSQKDIEIIKQRRGGDKFVEAHEDWITTISSAPEVISMTFVPITSLLSGVLGSGFLSHAINLYMRYKPPIEEIQHFLEFQIPRQWTPGYDLPLGPPRKEPLGPALQFSFLGPKLHISTNQVTVGHRPVTGLRLCLGGKKFNRLSLHLQHLTTVPKNLQPYWNTSSSNEAPVWKEPDEKNDRWFEPVQWKGFAHVATIPMEIEPHSKGTACAYIVTGAQLQVWELETKKVLFLRLLFSKIHGCSIRRSIWDHVASSFPQKPALFSQLGLSTSMSSNQQAMPTPFSLNSAVFPGGPPAPASNAKLLKFVNTTEMTKGAQDLPGHWLVTGAK

SEQ ID NO: 1026 - protein, 312 aa, Selaginella kraussiana (Variegata)
MEQEKTSAHFTASEAVQALGKGFDVTLDLRLAGCKGPHGRLVELDDTGRGDLFVQDRVVIPNVSKDIRCDKGEFTHFRSEVLTFHQMSERFNQELSITGKMPLGLFNHMYSFNGPWQADASSTKSLALDGRFITSYKLQIAKSPLVLRDEVKRAVPASWDPAALAKFIDTYGTHVIVSIKVGGKDVLYVRQHQSSPLSTTELQKLIKRFADQRFADTNGSVSDPRNVKNKMQPDLLAGRLPIESDTITAKEDVEIIFRRRGGSNLLRNHNEWLKTVAEAPDVISMTFVPITSLLNGVLGSGFLSHAVNLYLR

SEQ ID NO: 1027 - protein, 365 aa, Huperzia carriata (Philippines)
MNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQSSRWFEPVQWKGFSHVTTAPVELEANATDTAFAYVVIGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNTTEMTKGAKDLPGHWLVTGAKLDVENGKISLGVKYSLLHY

SEQ ID NO: 1028 - protein, 496 aa, Huperzia carinata
MDKKAVSNSTGEAKALEAVGALGRGYDVTLDLKLSYCKGSPESCLIQLDKQHLHDIVVPGGFTLFNISKDITCDKGERTRFRSDVLNFHEMSERFNQGLSINARIPLGLFNSMFNFRGPWHIDAQATKSLSLDGWFVTLYRMQIAKTPLVLCDEVKQAVPSSWDAAALANFIVKYGTHIVLSVKMGGKDAIYIRQQASSQLSPLEVQKYLKKIGDQKFRESKEPKEILNKEVTSAPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQNSRWFEPVQWKGFSHVTTAPVELEANATDTAFAYVVIGAQWSTAASLGAGFKEGAISETLVL

SEQ ID NO: 1029 - protein, 604 aa, Huperzia phlegmaria
MDKKAVSNSTVEAKALEAVGALGRGYDVTLDLKLSYCKGSPESCLIQLDKQNLHDIVVPGGFTLFNISKDITCDKGERTRFRSDVLTFHEMSERFNQGLSINARIPLGLFNSMFNFRGPWHIDAQATKSLSLDGWFVTLYKMQIAKTPLVLCDEVKQAVPSSWDAAALANFIVKYGTHIVLSVKMGGKDAIYIRQQAHSQLSPFEIQKNLKKIGDLKFHGSRESNYTLNKEVISASTSKNFARHLPISNTYDSISFVSQKDIEIIKQRRGGDKFVEAHEDWITTISSAPEVISMTFVPITSLLSGVLGSGFLSHAINLYMRYKPPIEEIQHFLEFQIPRQWTPGYDLPLGPPRKEPLGPALQFSFLGPKLHISTNEVTVGHRPVTGLRLCLGGKKFNRLSLHLQHLATVPKNLQPYWNTSSSNEAPVWKEPDEKNDRWFEPVQWKGFAHVTTIPMEIEPHSKGTACAYIVTGAQLQVWELETKKVLFLRLLFSKIHGCSIRRSIWDHVASSFPQKPALFSQLGLSTSMSSNQQAMPTPFSLNSAVFPGGPPAPAPNAKLLKFVNTTEMTKGAQDLPGHWLVTGAKLDVENGKISLGVKYSLLHY

SEQ ID NO: 1030 - protein, 394 aa, Platycerium bifurcatum
MSERFNQGLSINARIPLGLFNSMFNFRGPWHIDAQATKSLSLDGWFVTLYKMQIALVLCDEVKQAVPSSWDAAALANFIVKYGTHIVLSVKMGGKDAIYIRQQASSHLSPLEVQKYLKKIGDQKFRESKEPKEILNKEVTSVPTTMNLAQHLQFAKTYHSISFTSKKDIEIIMQRRGGNDFVEAHEEWLPTVSSAPEVISMTFVPIASLLNGVAGSGYLSHAINLYIRYKINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQNSRWFEPVQWKGFSHVTTAPVELEANATDTAFAYVVIGAQLQVWE

SEQ ID NO: 1031 - protein, 604 aa, Selaginella erythropus (Sanguinea)
MAQEKTAAFSTATEAVQALGKGFDVTLDLRLAGCKGPNGRLVEVNETNTEDLFVQDRVVIPNVSKDIRCDKGEFTHFRSEVLTFHQMSERFNQELSITGKMPLGLFNNMYSYNGPWQADASSTKSLALDGRFITSYKLQIVKSPLVLRDEVKKAVPASWDPAALAKFIDTYGTHVIASIKVGGKDVVYVRQHQSSPLSPTELQKFIKRFADQRFADTNGSVSDPRNIKDKTPDLLPGPNNQHRLQLETLGSGVVTAKEDVEIIFRRRGGSNLLRNHNEWLKTVAEAPDVISMTFVPITSLLNGVLGSGFLSHAVNLYLRHKPPIEDLQYFLEFQIPRQWSPGFDLPLGPQRKEPVCPAMQFSLMGPKLYVSTAQVTIGRRPVTGLRLFLEGKKCNRLGIHLQHLSSLPKILLPHWDSNVPIGPPVWKGPEEQDSKWFEPVQWKSFSHVSTQPVEFIEESYVGQTSGTYIVTGAQLGVWDFGMKKVLFLRLLFSRIPGCAIRRTVWDHSPTTSQKSGLFSQLGLSSTFSGAQKASKPTPVVLNSAVYPGGPPVPVPSRKLLKYVDITEMTKGAHDMPGHWIVTGAKLDVDRGRIALRLKYSLLHY

SEQ ID NO: 1032 - protein, 603 aa, Huperzia phlegmaria
MDKRAVLNSTVQSKAIEAVGALGRGYDVTLDLKLGYCKGSPESCLIELDKQHFHDIVVPGDFTLFNVSKDITCDKGERTRFRSDVLTFHEMSERFNQGLSINARIPLGLFNSMFNFRGPWHIDAQATKSLSLDGWFVTLYKMQIAKTPLVLCDEVKQAVPSSWDAAALANFIVKYGTHIVLSVKMGGKDAIYIRQQASSHLSPLEVQKYLKKIGDQKFREFKEPKEILNKEVTSAPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQNSRWFEPVQWKGFSHVTTAPVELEANATDTAFAYVVIGAQLQVWELDSKKVLFLRLLFLKIHGCSIRRSAWDHMPTLSQKSGLLSQLGLSTSMSSNQHAISTPFVQNSAVFPGGPPAPAPNAKLLKFVNITEMTKGAQDLPGHWLVTGAKLDVENGKISLGVKYSLLHY

SEQ ID NO: 1033 - protein, 625 aa, Huperzia tetratoides
MDKRTVVYPTAREKGLEAVRALGRGYDVTLDLKLGYCKGSRQSCLIQLDNENVHDIVVPGGFTLCNVSKDISCDKGERTRFRSDVLSFHEMSERFNQGLSINARIPLGLFNSMFNFRGPWHIDAQATKSLSLDGWFVTLYKMQIAKTSLVLCDEVKQAVPSSWDAAALASFIVKYGTHIVLSVKMGGKDAIYIRQQASSHLSPLEVQKYLKKIGDQRFRESREPKDILNKEVRSAPTTMNLAQHLQFAKTYHSISFMSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKRFNRLSLHLQHLATLPKSLQPYWKTSLSSEARLWKEPPKSLQPYWKTSLSSEARLWKEPEDQSSRWFEPVQWKGFSHVTTAPVELEANATDTSFAYVVIGAQLQVWELDSKKVLFLRLLFLKIHGCSIRRSAWDHMPSLSQKSGLLSQLGLSTSMSSNQHAISTPFVQNSAVFPGGPPAPAPNAKLLKFVNITEMTKGAQDLPGHWLVTGAKLDVENGKISLAVKYSLLHY

SEQ ID NO: 1034 - protein, 603 aa, Huperzia carinata
MDKRTVVYPTTREKGLEAVRALGRGYDVTLDLKLGYCKGSPKSCLIQLDNQNVHDIVVPGGFTLFNVSKDISCDKGERTRFRSDVLNFHEMSERFNQGLSINARIPLGLFNSMFNFRGPWHIDAQATKSLSLDGWFVTLYRMQIAKTPLVLCDEVKQAVPSSWDAAALANFIVKYGTHIVLSVKMGGKDVIYIRQQAQSQLSPFEIQKNLKNIGDLKFHGSRESSYTLNKEVISASTSKNFVQHLPVSNTYDSISFVSQKDIEIIKQRRGGDKFVEAHEDWVTTISSAPEVISMTFVPITSLLSGVLGSGFLSHAINLYMRYKPPIEEIQHFLEFQIPRQWTPGYDLPLGPPRKEPLGPALQFSFLGPKLRISTNQVTVGHKPVTGLRLCLGGKKLNRLSLHLQHLSTLPKSLQPYWKTSLSSEARLWKEPEDQNSRWFEPVQWKGFSHVTTAPVELEANATDTAFAYVVIGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNITEMTKGAQDLPGHWLVTGAKLDVENGKISLGVKYSLLHY

SEQ ID NO: 1035 - protein, 543 aa, Selaginella pallescens
MSERFNQELSITGKMPLGLFNHMYSFNGPWQADASSTKSLALDGRFITSYKLQIAKSPLVLRDEVKRAVPASWDPAALAKFIDTYGTHVIVSIKVGGKDVLYVRQHQSSPLSTTELQKLIKRFADQRFADTNGSVSDPRNVKNKMQPDLLAGRLPIESDTITAKEDEIIFRRRGGSNLLRNHNEWLKTVAEAPDVISMTFVPITSLLNGVLGSGFLSHAVNLYLRHKPPIEDLQYFLEFQIPRQWSPGFDLPLGPQRKEPVCPAMQFSLMGPKLYVSTAQVTIGRRPVTGLRLFLEGKKCNRLGIHLQHLSSLPKILQPHWDSNVPIGPPVWKGPEEQDSKWFEPVQWKSFSHVNVPIGPPVWKGPEEQDSKWFEPVQWKSFSHVSTQPVEFLEESYVGQTSGTYIVTGGQLGVWDFGMKKVLFLRLLFSRVPGCAIRRTIWDHSPTTSQKSGLFSQLGLSSTFSGAQKAAAAKPAPVVLNSAVYPGGPPVPVPSRKLLKYVDITEMTKGAHDMPGHWIVTGAKLDVDRGRIALRLKYSLLHY

SEQ ID NO: 1036 - protein, 604 aa, Huperzia phlegmaria
MDKRTVVYLTTREKGLEAVRALGRGYDVTLDLKLGYCKGSPKSCLIQLDNQNVHDIVVPGGFTLSNVSKDISCDKGERTRFRSDVLSFNEMSERFNQGLSINARIPLGLFNSMFNFRGPWHIDAQATKSLSLDGWFVTLYKMQIAKTPLVLCDEVKQAVPSSWDAAALANFIVKYGTHIVLSVKMGGKDAIYIRQQAHSQLSPFEIQKNLKKIGDLKFHGSRESNYTLNKEVISASTSKNFARHLPISNTYDSISFVSQKDIEIIKQRRGGDKFVEAHEDWITTISSAPEVISMTFVPITSLLSGVLGSGFLSHAINLYMRYKPPIEEIQHFLEFQIPRQWTPGYDLPLGPPRKEPLGPALQFSFLGPKLHISTNEVTVGHRPVTGLRLCLGGKKFNRLSLHLQHLATVPKNLQPYWNTSSSNEAPVWKEPDEKNDRWFEPVQWKGFAHVTTIPMEIEPHSKGTACAYIVTGAQLQVWELETKKVLFLRLLFSKIHGCSIRRSIWDHVASSFPQKPALFSQLGLSTSMSSNQQAMPTPFSLNSAVFPGGPPAPAPNAKLLKFVNTTEMTKGAQDLPGHWLVTGAKLDVENGKISLAVKYSLLHY

SEQ ID NO: 1037 - protein, 493 aa, Huperzia carriata (Philippines)
MSERFNQGLSINARIPLGLFNSMFNFRGPWHIDAQATKSLSLDGWFVTLYRIEKYGTHIVLSVKMGGKDAIYIRQQASSQLSPLEVQKYLKKIGDQKFRESKEPKEILNKEVTSAPTTMNLAQHLQFAKTYHSILQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQSSRWFEPVQWKGFSHVTTAPVELEANATDTAFAYVVIGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNTTEMTKGAKDLPGHWLVTGAKLDVENGKISLGVKYSLLHY

SEQ ID NO: 1038 - protein, 598 aa, Selaginella pallescens
MEQEKTSAHFTASEAVQALGKGFDVTLDLRLAGCKGPHGRLVELDDTSRGDLFVQDRVVIPNVSKDIRCDKGEFTHFRSEVLTFHQMSERFNQELSITGKMPLGLFNHMYSFNGPWQADASSTKSLALDGRFITSYKLQIAKSPLVLRDEVKRAVPASWDPAALAKFIDTYGTHVIVSIKVGGKDVLYVRQHQSSPLSTTELQKLIKRFADQRFADTNGSVSDPRNVKNKMQPDLLAGRLPIESDTITAKEDEIIFRRRGGSNLLRNHNEWLKTVAEAPDVISMTFVPITSLLNGVLGSGFLSHAVNLYLRHKPPIEDLQYFLEFQIPRQWSPGFDLPLGPQRKEPVCPAMQFSLMGPKLYVSTAQVTIGRRPVTGLRLFLEGKKCNRLGIHLQHLSSLPKILQPHWDSNVPIGPPVWKGPEEQDSKWFEPVQWKSFSHVSTQPVEFLEESYVGQTSGTYIVTGGQLGVWDFGMKKVLFLRLLFSRVPGCAIRRTIWDHSPTTSQKSGLFSQLGLSSTFSGAQKAAAAKPAPVVLNSAVYPGGPPVPVPSRKLLKYVDITEMTKGAHDMPGHWIVTGAKLDVDRGRIALRLKYSLLHY

SEQ ID NO: 1039 - protein, 432 aa, Huperzia carinata
MSERFNQGLSINARIPLGLFNSMFNFRGPWHIDAQATKSLSLDGWFVTLYRMQIAKTPLVLCDEVKQAVPSSWDAAALANFIVKYGTHIVLSVKMGGKDAIYIRQQASSQLSPLEVQKYLKKIGDQKFRESKEPKEILNKEVTSAPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQNSRWFEPVQWKGFSHVTTAPVELEANATDTAFAYVVIGAQLQVWELDSKKVLFLRLLFFKIQGCSIRRSAWDHMPSLSQRHSLTARTQ

SEQ ID NO: 1040 - protein, 604 aa, Huperzia tetratoides
MDKRTLVYPTAREKGLEAVRALGRGYDVTLDLKLGYCKGSRQSCLIQLDNENVHDIVVPGGFTLCNVSKDISCDKGERTRFRSDVLSFHEMSERFNQGLSINARIPLGLFNSMFNFRGPWHIDAQATKSLSLDGWFVTLYKMQIAKTSLVLCDEVKQAVPSSWDAAALASFIVKYGTHIVLSVKMGGKDVIYIRQQALSQLSPFEIQKNLKKIGDLSFHGSRESNHTLNKEVISASTSKHFAQHLPISHTYDSISFVSQKDIEIIEQRRGGDKFVKAHEDWVTTISSAPEVISMTFVPITSLLSGVLGSGFLSHAINLYMRYKPPVEEIQHFLEFQIPRQWTPGYDLPLGPPRKEPLGPALQFSFLGPKLYISTNQVTVGQRPVTGLRLCLGGKKFNRLSLHLQHLATVPKNLQPYWNTSSSSEAPVWKEPEEKSDRWFEPVQWKGFSHVATLPVEIEPHSKGTARAYIVTGAQLQVWELDTKKVLFLRLLFSKIHGCSIRRSIWDHVASSFSQKPALFSQLGLSTSMPSNQQAMPTPFSLNSAVFPGGPPAPAPNAKLLKFVNITEMTKGAQDLPGHWLVTGAKLDVENGKISLAVKYSLLHY

SEQ ID NO: 1041 - protein, 420 aa, Platycerium bifurcatum
MGGKDVIYIRQQAQSQLSPFEIQKNLKKIGDLKFHGSRESNYTLNKEVISASTSKNFVQHLPVSNTYDSISFVSQKDIEIIKQRRGGDKFVEAHEDWVTTISSAPEVISMTFVPITSLLSGVLGSGFLSHAINLYMRYKPPIEEIQHFLEFQIPRQWTPGYDLPLGPPRKEPLGPALQFSFLGPKLHISTNQVAVGHRPVTGLRLCLGGKKFNRLSLHLQHLATVPKNLQPYWNTSSSNEAPVWKEPDEKNDRWFEPVQWKGFAHVATIPMEIEPHSKGTACAYIVTGAQLQVWELETKKVLFLRLLFSKIHGCSIRRSIWDHVASSFPQKPALFSQLGLSTSMSSNQQAMPTPFSLNSAVFPGGPPAPAPNAKLLKFVNTTEMTKGAKDLPGHWLVTGAKLDVENGKISLGVKYSLLHY

SEQ ID NO: 1042 - protein, 603 aa, Huperzia carinata
MDKRAVLNSTVQSKAIEAVGALGRGYDVTLDLKLGYCKGSPESCLIELDKQHFHDIVVPGDFTLFNVSKDITCDKGERTRFRSDVLNFHEMSERFNQGLSINARIPLGLFNSMFNFRGPWHIDAQATKSLSLDGWFVTLYRMQIAKTPLVLCDEVKQAVPSSWDAAALANFIVKYGTHIVLSVKMGGKDAIYIRQQASSQLSPLEVQKYLKKIGDQRFRESREPKDIINKEATSTPTSMNLAQHLQIAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQNSRWFEPVQWKGFSHVTTAPVELEANATDTAFAYVVIGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNITEMTKGAQDLPGHWLVTGAKLDVENGKISLGVKYSLLHY

SEQ ID NO: 1043 - protein, 532 aa, Selaginella pallescens
MSERFNQELSITGKMPLGLFNHMYSFNGPWQADASSTKSLALDGRFITSYKLQIAKSPLVLRDEVKRAVPASWDPAALAKFIDTYGTHVIVSIKVGGKDVLYVRQHQSSPLSTTELQKLIKRFADQRFADTNGSVSDPRNVKNKMQPDLLAGRLPIESDTITAKEDEIIFRRRGGSNLLRNHNEWLKTVAEAPDVISMTFVPITSLLNGVLGSGFLSHAVNLYLRHKPPIEDLQYFLEFQIPRQWSPGFDLPLGPQRKEPVCPAMQFSLMGPKLYVSTAQVTFSCRFLPFFFLKQHFPAQVTIGRRPVTGLRLFLEGKKCNRLGIHLQHLSSLPKILQPHWDSNVPIGPPVWKGPEEQDSKWFEPVQWKSFSHVSTQPVEFLEESYVGQTSGTYIVTGGQLGVWDFGMKKVLFLRLLFSRVPGCAIRRTIWDHSPTTSQKSGLFSQLGLSSTFSGAQKAAAAKPAPVVLNSAVYPGGPPVPVPSRKLLKYVDITEMTKGAHDMPGHWIVTGAKLDVDRGRIALRLKYSLLHY

SEQ ID NO: 1044 - protein, 367 aa, Huperzia carriata (Philippines)
MDKKAVSNSTVEAKALEAVGALGRGYDVTLDLKLSYCKGSPESCLLQLDKQHLHDIVVPGGFTLFNISKDITCDKGERTRFRSDVLSFNEMSERFNQGLSINARIPLGLFNSMFNFRGPWHIDAQATKSLSLDGWFVTLYRMQITKTPLVLCDEVKQAVPSSWDAAALANFIVKYGTHIVLSVKMGGKDAIYIRQQASSQLSPLEVQKYLKKIGDQRFRESREPKDIINKEATSTPTSMNLAQHLQIAKTYNSISFVSKKDIEIIKQRRGGSDFVKSHEEWLTTVSSAPEVISMTFVPIASLLNGVAGSGYLSHAINLYIRYKPPIEEIQQFLEFQIPRQWTPGYDLPLRSALGTSKKRASGSCFAV

SEQ ID NO: 1045 - protein, 463 aa, Huperzia squarrosa
MQITTTSLVLRDEVKQEVPSAWDAAALANFIEKYGTHIVLSVKMGGKDVIYIRQQASSNLSPLEVQKYLKKIGDQRFRESREPTDILNKEVTSAPTTMNLAQHLQFAKTYHSISLTSKKDIEIIMQRRGGNDFVEAHEGWLQTVSSAPEVISMTFVPIASLLNGVAGSGYLSHAINLYIRYKPPIEEIQQFLEFQIPRQWTPGYDLPLGPQRKEPLGPALQFSFLGPKLHISTNQVSVGLRPVTGLRLYLGGKKFNRLSLHLQHLATLPKTLQPYWKTSLSSEARLWKEPEEQNSRWFEPVQWKGFSHVTTAPVELEPCATDTAFAYVVIGAQLQVWELDSKKVLFLRLLFLKIHGCSVRRSAWDHMPSLSQKSGLLSQLGLSSTSMSSNKHAASTPFVQNSAVFPGGPPALAPNAKLLKFVNITEMTKGAEDVPGHWLVTGAKLDVENGKISLGVKYSLLHY

SEQ ID NO: 1046 - protein, 603 aa, Huperzia nummulariifolia
MDKKAVSNSTVEAKALEAVGALGRGYDVTLDLKLSYCKGSPESCLIQLDKQHLHDIVVPGGFTLFNISKDITCDKGERTRFRSDVLSFNEMSERFNQGISINGRMPLGLFNSMFNFRGPWHIDAQATKSLSLDGWFVTLYKMQIAKTPLVLCEEVKQAVPSSWDAAALANFIVKYGTHIVLSVKMGGKDAIYIRQQAQSQLSPFEIQKNLKKIGDLKFHGSRESNYTLNKEVISASTSKNFVQHLPVSNTYDSISFVSQKDIEIIKQRRGGDKFVEAHEDWVTTISSAPEVISMTFVPITSLLSGVLGSGFLSHAINLYMRYKPPIEEIQHFLEFQIPRQWTPGYDLPLGPQRKEPLGPALQFSFLGPKLHISTNEVSVGLRPVTGLRLYLGGKKFNRLSLHLQHLATVPKNLQPYWNTSSSNEAPVWKEPDEKNDRWFEPVQWKGFAHVATIPMEIEPHSKGTACAYIVTGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNITEMTKGAQDLPGHWLVTGAKLDVENGKISLGVKYSLLHY

SEQ ID NO: 1047 - protein, 604 aa, Huperzia carinata
MDKRTVVYPTTREKGLEAVRALGRGYDVTLDLKLGYCKGSPKSCLIQLDNQNVHDIVVPGGFTLFNVSKDISCDKGERTRFRSDVLNFHEMSERFNQGLSINARIPLGLFNSMFNYNGPWHVDAQTTKSLALDGWFITLYKMQITMTSLVLRDEVKQAVPSTWDAAALANFIEKYGTHIVLSVKMGGKDVIYIRQQAQSQLSPFEIQKNLKNIGDLKFHGSRESSYTLNKEVISASTSKNFVQHLPVSNTYDSISFVSQKDIEIIKQRRGGDKFVEAHEDWVTTISSAPEVISMTFVPITSLLSGVLGSGFLSHAINLYMRYKPPIEEIQHFLEFQIPRQWTPGYDLPLGPPRKEPLGPALQFSFLGPKLRISTNQVTVGHKPVTGLRLCLGGKKLNRLSLHLQHLATVPKNLQAYWNTSSSNEAPVWKEPDEKNDRWFEPVQWKGFSHVTTIPMEIEPHSKGAACAFIVTGAQLQVWELETKKVLFLRVLFSKIHGCSIRRSIWDHVASSFPQKPALFSQLGLSTSMSSNQQAMPTPFSLNSAVFPDGPPAPAPNAKLLKFVNTTEMTKGAKDLPGHWLVTGAKLDVENGKISLGVKYSLLHY

SEQ ID NO: 1048 - protein, 393 aa, Selaginella erythropus (Sanguinea)
MAQEKTAAFSTATEAVQALGKGFDVTLDLRLAGCKGPNGRLVEVNETNTEDLFVQDRVVIPNVSKDIRCDKGEFTHFRSEVLTFHQMSERFNQELSITGKMPLGLFNNMYSYNGPWQADASSTKSLALDGRFITSYKLQIVKSPLVLRDEVKKAVPASWDPAALAKFIDTYGTHVIASIKVGGKDVVYVRQHQSSPLSPTELQKFIKRFADQRFADTNGSVSDPRNIKDKTPDLLPGPNNQHRLQLETLGSGVVTAKEDVEIIFRRRGGSNLLRNHNEWLKTVAEAPDVISMTFVPITSLLNGVLGSGFLSHAVNLYLRHKPPIEDLQYFLEFQIPRQWSPGFDLPLGPQRKEPVCPAMQFSLMGPKLYVSTAQVSPTLPRLCFASTFLPRFR

SEQ ID NO: 1049 - protein, 513 aa, Huperzia carriata (Philippines)
MSERFNQGLSINARIPLGLFNSMFNFRGPWHIDAQATKSLSLDGWFVTLYRMQITKTPLVLCDEVKQAVPSSWDAAALANFIVKYGTHIVLSVKMGGKDAIYIRQQASSQLSPLEVQKYLKKIGDQKFRESKEPKEILNKEVTSAPTTMNLAQHLQFAKTYHSISFTSKKDIEIIMQRRGGNDFVEAHEEWLPTVSSAPEVISMTFVPIASLLNGVAGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLATVPKNLQAYWNTSSSNEAPVWKEPDEKNDRWFEPVQWKGFSHVTTIPMEIEPHSKGAACAFIVTGAQLQVWELDSKKVLFLRLLFFKIQGCSIRRSAWDHMPSLSQKSGLLSQLGLSTSMSSNQHAISTPFVQNSAVFPGGPPAPAPNAKLLKFVNTTEMTKGAKDLPGHWLVTGAKLDVEDGKISLGVKYSLLHY

SEQ ID NO: 1050 - protein, 603 aa, Huperzia squarrosa
MDKRAVLNSTVQSKAIEAVGALGRGYDVTLDLKLGYCKGSPESCLIELDKQHFHDIVVPGDFTLLNVSKDITCDKGERTRFRSDVLSFHEMSERFNQGTSINGRMPLGLFNSMFNFRGPWHIDAQATKSLSLDGWFVTLYKMQVSRTSLVLCDEVKQAVPSSWDAAALASFIEKYGTHIVLSVKMGGKDVIYIRQQASSNLSPLEVQKYLKKIGDQRFRESREPTDILNKEVTSAPTTMNLAQHLQFAKTYHSISLTSKKDIEIIMQRRGGNDFVEAHEGWLQTVSSAPEVISMTFVPIASLLNGVAGSGYLSHAINLYIRYKPPIEEIQQFLEFQIPRQWTPGYDLPLGPQRKEPLGPALQFSFLGPKLHISTNQVSVGLRPVTGLRLYLGGKKFNRLSLHLQHLATLPKSLQPYWKTSLSSEARMWKEPEDQSSRWFEPVQWKGFSHVTTAPVELEANATDTAFAYVVIGAQLQVWELDSKKVLFLRLLFLKIHGCSVRRSAWDHMPSLSQKSGLLSQLGLSTSMSSNQHAVSTPFVQNSAVFPGGPPAPAPNAKLLKFVNITEMTKGAEDVPGHWLVTGAKLDVENGKISLGVKYSLLHY

SEQ ID NO: 1051 - protein, 603 aa, Huperzia carriata (Solomon Islands)
MDKKAVSNSTVEAKALEAVGALGRGYDVTLDLKLSYCKGSPESCLIQLDKQHLHDIVVPGGFTLFNISKDITCDKGERTRFRSDVLTFHEMSERFNQGLSINARIPLGLFNSMFNFRGPWHIDAQATKSLSLDGWFVTLYRMQIAKTPLVLCDEVKQAVPSSWDAAALANFIVKYGTHIVLSVKMGGKDVIYIRQQASSHLSPLEVQKYLKKIGDQKFRESKEPKEILNKEVTSAPTTMNLAQHLQFAKTYHSISFTSKKDIEIIMQRRGGNDFVEAHEEWLPTVSSAPEVISMTFVPIASLLNGVSGSGYLSHAINLYIRYKPPIEEIQQFLEFQIPRQWTPGYDLPLGPQRKEPLGPALQFSFLGPKLHISTNEVSVGLRPVTGLRLYLGGKKFNRLSLHLQHLSTLPKSLQPYWKTSLSSEARLWKEPEDQNSRWFEPVQWKGFSHVTTAPVELEGNATDTAFAYVVIGAQLQVWELDSKKVLFLRLLFLKIHGCSVRRSAWDHMPSLSQKSGLLSQLGLSTSMSSNQHAISTPFVQNSAVFPGGPPAPAPNAKLLKFVNITEMTKGAEDVPGHWLVTGAKLDVENGKISLGVKYSLLHY

SEQ ID NO: 1052 - protein, 518 aa, Huperzia salvinioides
MAERFNEALNISGKVPLGLFNTMFSFNGTWQSDASAIKALAVDCWVISLYNMQISKTLKNLKEEVKKAVPPFWEPAALARFIEKYGTHIIMSVKIGGRDVVYIKQYQSSTLSPEEIKRYLREIADQRFAEGSGQGISNMQSKEKSSDPLTSANHAHRLQMANTHTSTSFTAKGDVEVIFRRRGGDCTVKHHSDWLDTVPSSPDVVEMSFIPITALLNGVPGSGFLSHAIKLYLRYKPPIEELQFFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGLLSQLGLSTTFSSASKAKPAPVVLNSAVFPEGPPVPVQNLKFLKFVDVKEMSKGAQDVPGHWLVTGAKLDVDKGKIALRVKYSLLHY

SEQ ID NO: 1053 - protein, 617 aa, Huperzia salvinioides
MVWAGDQEMAQTDSDRMAAQATAREALQALGRGFDVTLDLRLAYCKGPSGSRIIEFDEEANLDLVIPGGAAIIPNVSRDIRCEKGERKHFRSDVLPFHQMAERFNEALNISGKVPLGLFNTMFSFNGTWQSDASAIKALAVDCWVISLYNMQISKTLKNLKEEVKKAVPPFWEPAALARFIEKYGTHIIMSVKIGGRDVVYIKQYQSSTLSPEEIKRYLREIADQRFAEGSGQGISNMQSKEKSSDPLTSANHAHRLQMANTHTSTSFTAKGDVEVILRRRGGDCMVKHHSDWLATVPFSPDVIAMSFIPITALLNGVPGSGFLSHAIKLYLRYKPPIEELQFFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGLLSQLGLSTTFSSASKAKPAPVVLNSAVFPEGPPVPVQNLKFLKFVDVKEMSKGAQDVPGHWLVTGAKLDVDKGKIALRVKYSLLHY

SEQ ID NO: 1054 - protein, 617 aa, Huperzia salvinioides
MVWAGDQEMAQTDSDRMAAQATAREALQALGRGFDVTLDLRLAYCKGPSGSRIIEFDEEANLDLVIPGGAAIIPNVSRDIRCEKGERKHFRSDVLPFHQMAERFNEALNISGKVPLGLFNTMFSFNGTWQSDASAIKALAVDCWVISLYNMQISKTLKNLKEEVKKAVPPFWEPAALARFIEKYGTHIIMSVKIGGRDVVYIKQYQSSTLSPEEIKRYLREIADQRFAEGSGQGISNMQSKEKSSDPLTSANHAHRLQMANTHTSTSFTAKGDVEVIFRRRGGDCTVKHHSDWLDTVPSSPDVVEMSFIPITALLNGVPGSGFLSHAIKLYLRYKPPIEELQFFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGLLSQLGLSTTFSSASKAKPAPVVLNSAVFPEGPPVPVQNLKFLKFVDVKEMSKGAQDVPGHWLVTGAKLDVDKGKIALRVKYSLLHY

SEQ ID NO: 1055 - protein, 616 aa, Huperzia nummulariifolia
MGIDWAGDQMAYREAERTIAQSTAIEALQCLGRGFDVTLDLRLAYCKGPSGSLLVELSEETYPEIVLPGGVVITNVSKDIKCDKGERTHFRSEVLTFHQMSTRFNEALSITGKMPLGLFNTMFSFNGTWQGDASETKALALDGWFITLYNMQITKPELSLNEEVKKAVPSSWEPAALARFIEKYGTHIIVSVKLGGKDVVYLKQYESSLLSSGEVQKYLKVIADQRFSEEAGQNISDTHLKDKLPDPLTSTNHAHRLQMASNFTSSSFTTIKDVELIVRRRGGDSLVKRHNDWLATVSSAPDVVSMSFVAISSLLNGVPGSGFLSHAVNLYLRYKPPIEELQFFLEFQIPKQWSPGFDLPLGPQRKGPVCPAMQFSLMGPKLYVCTTQVTVGRRPVTGLRLFLEGKKGNRLTIHLQHLSNLPKILQPHWDQHIAIGPPIWKEPEEQDSKWFEPVQWKSFSHVSTAPLEYLVESYVGEINSTYIVTGAQLRVWDFGIKNVLFLRLLFCRVPGCSIKRSFWDHTPQASQKSNLFSQLGLSSISSARKAKPVPIVLNSAVFPDDPPQSTQTHKLLKFVDIKEMTKGAQDKPGHWLVTGAKLDVDGGKIALGVKYSLLHY

SEQ ID NO: 1056 - protein, 613 aa, Huperzia nummulariifolia (Blume)
MVWAGHQQMAQKEPGKLAAEVTAREAVQAIGRGFDVTLDLRLAYCKGPAGSRLIELDEEKNVDMVIPGGGFVLQGVSRDIRCDKGERTRFRSEVLSFHHMSERFNQALCISGKMPLGLFNAMYNLNGTWQSDASATKSLALDGWFISLYNLQLRKASLTLKEEVKEAVPSVWEPAALARFIDRYGTHIIESVKVGGKDVVYTRQYQSSPLTPGDIQKYLKELADQRFAEGSGQNNVNMRAKEKSLDPFTVTNHAHRLQLASTNTSSSFTAKGDVEVNYKRRGGDNLVRFHGDWLATVPLSPDVVSMSFVPITSLLNGVPGSGFLSHAINLYLRYKPPIEELRSFLEFQIPRQWCPGFDLPLGPQRKEPVCPSLQFSFMGPKLYINTAQVIVGRRPVTGLQLFLEGKKGNRLAIHLQHLSNLPKILQPHWGQHISVGDPVWKQPEEQETKWFEPVQWKSFSHVSTAPIEYGKEDDLIANIVTGAQLQVWDLGAKKVLFLRLLFSKVPGCSIKTSFWDHTPQSSQKSGLFSQLGLSTNFTSARKAKPAAVILNSAIFPEGPPAAVQKLKLLKFVDVKEMTKGAQDTPGHWLVTGARLDADRGKIAIRVKYALLLY

SEQ ID NO: 1057 - protein, 303 aa, Huperzia phlegmaria
MVWAGDQEMAQIEPDRMAAQATAREALQALGRGFDVTLDLRLAYCKGPSGSRIIEFDEEANLDLVIPGGVAIIPNVSGDIRCEKGERTHFISDVLSFHQMAERFNEALNISGKVPSGFFNTVFSLNGTWQSDASAIKALAVDCWVISLYNMQISRTPKNLKEEVKKAVPPFWEPAALARFIEKYGTHIIMSVKIGGKDVVYLRQYQSSTLSPGEIKKYLKEIADQRFAEGSGHDISNMQSKEKSSDPLTSANHAHRLQMANTHTSTSFTAKGDVEVIFRRRGGDCTVKHHSDWLDLFLLPLMS

SEQ ID NO: 1058 - protein, 613 aa, Huperzia tetratoides
MVSAGHRQMAQKEPGKLAAEVTAREAVQAIGRGFDVTLDLRLAYCKGPAGSRLIELDEEKNVDMVIPGGGFVLRGVSRDIRCDKGERTRFRSEVLSFHHMSERFNQALSISGKMPLGLFNTMYSLNGTWQSDASATKSLALDGWFISLYNLQLRKASLTLKEEVKEAVPSVWEPAALARFIDKYGTHIIESVKVGGKDVVYTRQYQSSPLTSGDIQKYLKELADQRFAEGSGTNNVNMRAKEKSPDPFTVTNHAHRLQLASTNTSSSFTAKGDVEVNFKRRGGDNLVRFHGDWLATVPLSPDVISMSFVPITSLLNGVPGSGFLSHAVNLYLRYKPPIEELRSFLEFQIPRQWSPGFDLPLGPQRKEPACPSLQFSFMGPKLYINTAQVIVGRRPVTGLQLFLEGKKGNRLAIHLQHLSNLPKILQPHWGQHISVGPPVWKQPEEQDTKWFEPVQWKSFSHVSTAPIEYGKEDDLIANIVTGAQLQVWELGAKKVLFLRLLFSKVPGCSIKTSFWDHTPQSSQKSGLFSQLGLSTNFTSARKAKPAAVILNSAIFPEGPPAAVQKLKLLKFVDVKEMTKGAHDTPGHWLVTGARLDADRGKIALRVKYALLLY

SEQ ID NO: 1059 - protein, 403 aa, Huperzia salvinioides
MVWAGHQQMAQKEPGKLAAEVTAREAVQAIGRGFDVTLDLRLAYCKGPAGSRLIELDEEKNVDMVIPGGGFVLQGVSRDIRCDKGERTRFRSEVLSFHHMSERFNQALCISGKMPLGLFNAMYNLNGTWQSDASATKSLALDGWFISLYNLQLRKASLTLKEEVKEAVPSVWEPAALARFIDRYGTHIIESVKVGGKDVVYTRQYQSSPLTPGDIQKYLKELADQRFAEGSGQNNVNMRAKEKSLDPFTVTNHAHRLQLASTNTSSSFTAKGDVEVNYKRRGGDNLVRFHGDWLATVPLSPDVVSMSFVPITSLLNGVPGSGFLSHAINLYLRYKPPIEELRSFLEFQIPRQWCPGFDLPLGPQRKEPVCPSLQFSFMGPKLYINTAQVQFHFKFVKSRLSKI

SEQ ID NO: 1060 - protein, 617 aa, Platycerium bifurcatum
MVWAGHQQMAQKEPGKFVAEVTAREAVQAIGRGFDVTLDLRLAYCKGPAGSRLIELDEEKNVDMVIPGGGFVLQGVSRDIRCDKGERTRFRSEVLSFHHMSERFNQALSIPGKMPLGLFNTMFSFNGTWQGDASETKALALDGWFITLYNMQITKPELSLNEEVKKAVPSSWEPAALARFIEKYGTHIIVSVKLGGKDVVYLKQYESSLLSSGEVQKYLKVIADQRFSEEAGQNISDTHLKDKLPDPLTSTNHAHRLQMASNFTSSSFTTIKDVELIVRRRGGDSLVKRHNDWLATVSSAPDVVSMSFVAISSLLNGVPGSGFLSHAVNLYLRYKPPIEELQFFLEFQIPKLWSPGFDLPLGPQRKGPVCPAMQFSLMGPKLYVCTTQVTVGRRPVTGLRLFLEGKKGNRLTIHLQHLSNLPKILQPHWDQHIAIGPPIWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDKGKIALRVKYSLLHY

SEQ ID NO: 1061 - protein, 617 aa, Huperzia tetratoides
MVWAGDQEMVQKEPDRMVAQATAREALQALGRGFDVTLDLRLAYCKGPPGSCLIELDEEEKSEILIPGGAAIIPDVSRDIKCDKGERTHFSSEVLPFEQMSERFNQALSISGKVPLGLFNTMFSLNGTWQSDASATKALAVDGWFISLYNMQISKTPQSLKEEVIKAVPPFWEPAALASFIEKYGTHIIMSVKIGGKDVVYIRQYQSSPLSPGEIKRYLKEIADQRFAEGSEQFMSNTRSNEKSPIPLTSTSHAHRLQMANAYTSASFTTKGDVEVILRRRGGDCMVKHHSDWLATVPFSPDVIAMSFIPITSLLNGVPGSGFLSHAISLYLQYKPPIEELQLFLEFQIPRQWSPGFDLPFGCQRKEPVYPSLQFSLMGPKLYVSTAQVTVGRRPVTGLRLCLEGKKGNRLAIHLQHLSNLPKILQPHWDQHIPIGLPVWKEPEEQDSKWFEHVQWKSFSHVSTAPIEYRRESYVGETSAVYIVTGAQLRVWDFGLKNVLFLRLLFLKVPGCSVKRSIWDHAPQASQKSGLFSQFGLSTNFTSAHKAKPAPVVLNSAVFPEGPPAPAQNLKLLKFVDVKEMSKGAQDVPGHWLVTGAKLDVDKGKIALRLKYSLLHY

SEQ ID NO: 1062 - protein, 617 aa, Huperzia nummulariifolia
MVWAGDQEMVQNEPDRMAAQAIAREALQALGRGFDVTLDLRLAYCKGPPGSCLIELDEEEKSDILIPGGAAIIPDVSRDIKCDKGERTHFSSEVLPFEQMSERFNQALCISGKMPLGLFNSMYNLNGTWQSDASATKALAVEGWFISLYNMQISKIPLRLKEEVKKAVPPCWEPAALASFIEKYGTHIITSVKIGGKDVVYIRQYQSSPLSPGEIKSYLKEIADQRFAEGSEQFMLNMRSNEKSPIPLTSTSHAHRLQMANAYTSASFTTKGDVEVILRRRGGDCMVKHHSDWLATVPFSPDVIAMSFIPITALLNGVPGSGFLSHAINLYLRYKPPIEELQFFLEFQIPRQWSPGFDLPLVPQRKEPVCPSLQFSLMGPKIYVSTNQVTVGRRPVTGLRLFLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDKGKIALRVKYSLLHY

SEQ ID NO: 1063 - protein, 371 aa, Huperzia nummarifolia
MVWAGDQEMAQTEPDRMAAQAIAREALQALGRGFDVTLDLRLAYCKGPPGSCLIELDEEEKSDILIPGGAAIIPDVSRDIKCDKGERTHFSSEVLPFEQMSERFNQALCISGKMPLGLFNSMYNLNGTWQSDASATKALAVEGWFISLYNMQISKIPLRLKEEVKKAVPPCWEPAALASFIEKYGTHIITSVKIGGKDVVYIRQYQSSPLSPGEIKRYLKEIADQRFAEGSEQFMLNMRSNEKSPIPLTSTSHAHRLQMANAYTSASFTTKGDVEVILRRRGGDCMVKHHSDWLATVPFSPDVIAMSFIPITALLNGVPGSGFLSHAINLYLRYKPPSFWNFRFPDSGLQVLTCQLSPREKNLYVRHCNSA

SEQ ID NO: 1064 - protein, 617 aa, Huperzia tetratoides
MVWAGDQEMVQKEPDRMVAQATAREALQALGRGFDVTLDLRLAYCKGPPGSCLIELDEEEKSEILIPGGAAIIPDVSRDIKCDKGERTHFSSEVLPFEQMSERFNQALSISGKVPLGLFNTMFSLNGTWQSDASATKALAVDGWFISLYNMQISKTPQSLKEEVIKAVPPFWEPAALASFIEKYGTHIIMSVKIGGKDVVYIRQYQSSPLSPGEIKRYLKEIADQRFAEGSEQFMSNTRSNEKSPIPLTSTSHAHRLQMANAYTSASFTTKGDVEVIFRRRGGDCMVKHHSDWLATVPSSPDVIAMTFIPITSLLNEVPGSGFLSHAISLYLQYKPPIEELQFFLEFQISRQWSPGFDLPLVPQRKEPVCPSLQFSLMGPKLYVSTAQVTVGRRPVTGLRLCLEGKKGNRLAIHLQHLSNLPKILQPHWDQHIPIGLPVWKEPEEQDSKWFEHVQWKSFSHVSTAPIEYRRESYVGETSAVYIVTGAQLRVWDFGLKNVLFLRLLFLKVPGCSVKRSIWDHAPQASQKSGLFSQFGLSTNFTSAHKAKPAPVVLNSAVFPEGPPAPAQNLKLLKFVDVKEMSKGAQDVPGHWLVTGAKLDVDKGKIALRLKYSLLHY

SEQ ID NO: 1065 - protein, 450 aa, Huperzia phlegmaria
MKERIYHYSSHMGIDWAGDQMAYREAERTIAQSTAIEALQCLGRGFDVTLDLRLAYCKGPSGSLLVELSEETYPEIVLPGGVVITNVSKDIKCDKGERTHFRSEVLTFHQMSTRFNEALSITGKMPLGLFNTMFSFNGTWQGDASETKALALDGWFITLYNMQITKPELSLNEEVKKAVPSSWEPAALARFIEKYGTHIIVSVKLGGKDVVYLKQYESSLLSSAEVQKYLKVTADQRFSEEAGLNISDTHLKDKLPDPLTSTNHAHRVPTASNFTSSSFTTIKDVEVILRRRGGDSLVKRHNDWLATVSSAPDVVSMSFVAISSLLNGVPGSGFLSHAVNLYLRYKPPIEELQFFLEFQIPKQWSPGFDLPLGPQRKGPVCPALQFSLMGPKLYVCTTQVTVGRRPVTGLRLFLEGKKGNRLTIHLQHLSNLPKILQPHWDQHIAIGPPI

SEQ ID NO: 1066 - protein, 624 aa, Platycerium bifurcatum
MGIDWAGDQMDWAGDQMAYREAERTIAQSTAIEALQCLGRGFDVTLDLRLAYCKGPSGSLLVELSEETYPEIVLPGGVVITNVSKDIKCDKGERTHFRSEVLTFHQMSTRFNEALSITGKMPLGLFNTMFSFNGTWQGDASETKALALDGWFITLYNMQITKPELSLNEEVKKAVPSSWEPAALARFIEKYGTHIIVSVKLGGKDVVYLKQYESSLLSSGEVQKYLKVIADQRFSEEAGQNISDTHLKDKLPDPLTSTNHAHRLQMASNFTSSSFTTIKDVELIVRRRGGDSLVKRHNDWLATVSSAPDVVSMSFVAISSLLNGVPGSGFLSHAVNLYLRYKPPIEELQFFLEFQIPKLWSPGFDLPLGPQRKGPVCPAMQFSLMGPKLYVCTTQVTVGRRPVTGLRLFLEGKKGNRLTIHLQHLSNLPKILQPHWDQHIAIGPPIWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDKGKIALRVKYSLLHY

SEQ ID NO: 1067 - protein, 512 aa, Huperzia tetratoides
MSERFNQALSISGKMPLGLFNTMYSLNGTWQSDASATKSLALDGWFISLYNLQLRKASLTLKEEVKEAVPSVWEPAALARFIDKYGTHIIESVKVGGKDVVYTRQYQSSPLTSGDIQKYLKELADQRFAEGSGTNNVNMRAKEKSPDPFTVTNHAHRLQLASTNTSSSFTAKGDVEVNFKRRGGDNLVRFHGDWLATVPLSPDVISMSFVPITSLLNGVPGSGFLSHAVNLYLRYKPPIEELRSFLEFQIPRQWSPGFDLPLGPQRKEPACPSLQFSFMGPKLYINTAQVIVGRRPVTGLQLFLEGKKGNRLAIHLQHLSNLPKILQPHWGQHISVGPPVWKQPEEQDTKWFEPVQWKSFSHVSLSNLPKILQPHWGQHISVGPPVWKQPEEQDTKWFEPVQWKSFSHVSTAPIEYGKEDDLIANIVTGAQLQVWELGAKKVLFLRLLFSKVPGCSIKTSFWDHTPQSSQKSGLFSQLGLSTNFTSARKAKPAAVILNSAIFPEGPPAAVLC

SEQ ID NO: 1068 - protein, 322 aa, Huperzia phlegmaria
MVWAGHQQMAQKEPGKLAAEVTAREAVQAIGRGFDVTLDLRLAYCKGPAGSRLIELDEEKNVDMVIPGGGFILQGVSRDIRCDKGERTRFRSEVLSFHHMSERFNQALCISGKMPLGLFNAMYNLNGTWQSDASATKSLALDGWFISLYNLQLRKASLTLKEEVKEAVPSVWEPAALARFIDKYGTHIIESVKVGGKDVVYTRQYQSSPLTPGDIQKYLKELADQRFAEGSGQNNVNMRAKEKSLDPFTVTNHAHRLQLASTNTSSSFTAKGDVEVNYKRRGGDNLVRFHGDWLATVPLSPDVVSMSFVPITSLLNGGDWYK

SEQ ID NO: 1069 - protein, 606 aa, Huperzia squarrosa
MTQTEPDRMVAQATAREALQALGRGFDVTLDLRLAYCKGPPGSCLIELDEEEKSDILIPGGAAIIPDVSRDIKCDNGERTHFSSEVLPFEQMSERFNQALSISGKMPLGLFNTMYSLNGTWQSDASATKALAVDGWFISLYNMQISKTPQSLKEEVIKAVPPFWEPAALASFIEKYGTHIIMSVKIGGKDVVYIRQYQSSPLSPGEIKRYLKEIADQRFAEGSEQFMSNVRSNEKSPIPLTSTSHAHRLQMANAYTSASFTTKGDVEVILRRRGGDCMVKHHSDWLATVPFSPDVIAMSFIPITALLNGVPGSGFLSHAINLYLRYKPPIEELRLFLEFQIPRQWSPGFDLPFGCQRKEPVYPSLQFSLMGPKLYVSTAQVTVGRRPVTGLRLCLEGKKGNRLAIHLQHLSNLPKILQPHWDQHLPIGLPVWKEPEEQDSKWFEPVQWKSFSHVSTAPIEYRRESYVGETSAVYIVTGAQLRVWDFGLKNVLFLRLLFLKVPGCSVKRTVWDHSPESSQKSGLFPQLGLSTIFSSARKAKPAPVVLNSAVFPEGAVQNLKFLKFVDIKEMTKGAQDMPGHWLVTGAKLDVDKGKIALRLKYSLLHY

SEQ ID NO: 1070 - protein, 617 aa, Huperzia nummarifolia
MVWAGDQEMAQTEPDRMAAQAIAREALQALGRGFDVTLDLRLAYCKGPSGSRIIEFDEKSNLDLVIPGGAAIIPNVSGDIRCEKGERKHFRSDVLPFHQMAERFNEALNISGKVPLGFFNTMFSLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKSSDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRQWSPGFDLPIVPQRKEPVCPSLQFSLMGPKIYVSTNQVTVGRRPVTGLRLFLEGKKGNRLAIHLQHLSSLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRSVWDHTPQASQKSGLFSQFGLSTNFTSAHKAKPAPVVLNSAVFPEGPPAPAQNLKLLKFVDVKEMSKGAQDVPGHWLVTGAKLDVDKGKIALRLKYSLLHY

SEQ ID NO: 1071 - protein, 587 aa, Huperzia nummarifolia
MVWAGDQEMAQTEPDRMAAQAIAREALQALGRGFDVTLDLRLAYCKGPSGSRIIEFDEKSNLDLVIPGGAAIIPNVSGDIRCEKGERKHFRSDVLPFHQMAERFNEALNISGKVPLGFFNTMFSLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKDVEVIFRRRGGDCTVKHHSDWLATVPSSPDVMAMTFIPITSLLNEVPGSGFLSHAINLYLRYKPPIEELQFFLEFQIPRQWSPGFDLPIVPQRKEPVCPSLQFSLMGPKIYVSTNQVTVGRRPVTGLRLFLEGKKGNRLAIHLQHLSSLPKILQPHWDQHIPIGLPVWKEPEEQDSKWFEPVQWKSFSHVSTAPLEYLVESYVGEINSTYIVTGAQLRVWDFGIKNVLFLRLLFCRVPGCSIKRSFWDHTPQASQKSNLFSQLGLSSISSARKAKPVPIVLNSAVFPDDPPQSTQTHKLLKFVDIKEMTKGAQDKPGHWLVTGAKLDVDGGKIALGVKYSLLHY

SEQ ID NO: 1072 - protein, 518 aa, Huperzia goebelii (Holub)
MAERFNEALNISGKVPLGLFNTVFSLNGTWQSDASAIKALAVDCWVISLYNMQISKTPKNLKEEVKKAVPPFWEPAALARFIEKYGTHIIMSVKIGGRDVVYIKQYQSSTLSPEEIKRYLREIADQRFAEGSGQGISNMQSKEKSSDLLTSANHAHRLQMANTHTSTSFTAKGDVEVIFRRRGGDCTVTHHSDWLATVPSSPDVVAMTFIPITSLLNEVPGSGFLSHAINLYLRYKPPIEELQFFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGLFSQLGLSTTFSSASKAKPVPVVLNSAVFPEGPPVPVQNLKFLKFVDVKEMMKGAQDMPGHWLVTGAKLDVDKGKIALRVKYSLLHY

SEQ ID NO: 1073 - protein, 333 aa, Huperzia salvinioides
MVWAGDQEMAQTDSDRMAAQATAREALQALGRGFDVTLDLRLAYCKGPSGSRIIEFDEEANLDLVIPGGAAIIPNVSRDIRCEKGERKHFRSDVLPFHQMAERFNEALNISGKVPLGLFNTMFSFNGTWQSDASAIKALAVDCWVISLYNMQISKTLKNLKEEVKKAVPPFWEPAALARFIEKYGTHIIMSVKIGGRDVVYIKQYQSSTLSPEEIKRYLREIADQRFAEGSGQGISNMQSKEKSSDPLTSANHAHRLQMANTHTSTSFTAKGDVEVIFRRRGGDCTVKHHSDWLDTVPSSPDVVEMSFIPITALLNGVPGSGFLSHAIKLYLR

SEQ ID NO: 1074 - protein, 443 aa, Huperzia nummarifolia
MSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKDVEVIFRRRGGDCTVKHHSDWLATVPSSPDVMAMTFIPITSLLNEVPGSGFLSHAINLYLRYKPPIEELQFFLEFQIPRQWSPGFDLPIVPQRKEPVCPSLQFSLMGPKIYVSTNQVTVGRRPVTGLRLFLEGKKGNRLAIHLQHLSSLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDRGKIALRVKYSLLHY

SEQ ID NO: 1075 - protein, 603 aa, Huperzia nummulariifolia
MVWAGDQEMVQNEPDRMAAQAIAREALQALGRGFDVTLDLRLAYCKGPPGSCLIELDEEEKSDILIPGGAAIIPDVSRDIKCDKGERTHFSSEVLPFEQMSERFNQALCISGKMPLGLFNSMYNLNGTWQSDASATKALAVDCWVISLYNMQIFKTPKNLKEEVKKAVPPFWEPAALARFIEKYGTHIIMSVKIGGKDVVYIRQYQSSTLSPGEIKKYLKEIADQRFAEGSGHDISNMQSKEKSSDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRQWSPGFDLPLVPQRKEPVCPSLQFSLMGPKIYVSTNQVTVGRRPVTGLRLFLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDK

SEQ ID NO: 1076 - protein, 651 aa, Huperzia nummarifolia
MVWAGDQEMVQNEPDRMAAQAIAREALQALGRGFDVTLDLRLAYCKGPSGSRIIEFDEKSNLDLVIPGGAAIIPNVSGDIRCEKGERKHFRSDVLPFHQMAERFNEALNISGKVPLGFFNTMFSLNGTWQSDASATKALAVDCWVISLYNMQIFKTPKNLKEEVKKAVPPFWEPADGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKSSDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRQWSPGFDLPIVPQRKEPVCPSLQFSLMGPKIYVSTNQVTVGRRPVTGLRLFLEGKKGNRLAIHLQHLSSLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRSVWDHTPQASQKSGLFSQFGLSTNFTSAHKAKPAPVVLNSAVFPEGPPAPAQNLKLLKFVDVKEMSKGAQDVPGHWLVTGAKLDVDKGKIALRLKYSLLHY

SEQ ID NO: 1077 - protein, 436 aa, Huperzia tetratoides
MGMVWAGDQMAYREAERTIAQSTAIEALQCLGRGFDVTLDLRLAYCKGPSGSRLVELSEETYPEIVLPGGVVIPNVSKDIKCDKGERTHFRSEVLTFHQMSTRFNEALSITGKMPLGLFNTMFSFNGTWQGDASETKALALDGWFITLYNMQITKPELSLNEEVKKAVPSSWEPAALARFIEKYGTHIIVSVKLGGKDVVYLKQFESSLLSSGEVQKYLKVIADQRFSEEAGQNISDTRLKDKSPDPLTSTNHAQRLQMASNVTSSSFSPIKDVEVILRRRGGDSLVKHHNDWLATVSSAPDVVSMSFVAISSLLNGVPGSGFLSHAVNLYLRYKPPIEELQFFLEFQIPKQWSPGFDLPLGPQRKGPVCPAMQFSLMGPKLYVCTTQVTVGRRPVTGLRLFLEGKKGNRLTIHLQHLSNLPKILQPHWDQHIASW

SEQ ID NO: 1078 - protein, 333 aa, Huperzia carinata
MVWARDQEMAQTDSDRMAAQATAREALQALGRGDEEANLDLVIPGGAAIIPNVSRDIRCEKGERKHFRSDVLPFHQMAERFNEALNISGKVPLGFFNTVFSLNGTWQSDASATKALAVDCWVISLYNMQISKTPKNLKEEVKKAVPPFWEPAALARFIEKYGTHIIMSVKIGGRDVVYIKQYQSSTLSPEEIKRYLREIADQRFAEGSGQGISNMQSKEKSSDPVTSANHAHRLQMANTHTSTSFKAKGDVEVIFRRKGGDCTVKHHSDWLATVPSSPDVVEMTFIPITSLLNEVPGSGFLSHAIKLYLRYKPPIEELQFFLEFQIPRVVSRF

SEQ ID NO: 1079 - protein, 617 aa, Huperzia nummulariifolia
MVWAGDQEMVQNEPDRMAAQAIAREALQALGRGFDVTLDLRLAYCKGPPGSCLIELDEEEKSDILIPGGAAIIPDVSRDIKCDKGERTHFSSEVLPFEQMSERFNQALCISGKMPLGLFNSMYNLNGTWQSDASATKALAVEGWFISLYNMQISKIPLRLKEEVKKAVPPCWEPAALASFIEKYGTHIITSVKIGGKDVVYIRQYQSSPLSPGEIKSYLKEIADQRFAEGSEQFMLNMRSNEKSPIPLTSTSHAHRLQMANAYTSASFTTKGDVEVILRRRGGDCMVKHHSDWLATVPFSPDVIAMSFIPITALLNGVPGSGFLSHAINLYLRYKPPIEELQFFLEFQIPRQWSPGFDLPLVPQRKEPVCPSLQFSLMGPKIYVSTNQVTVGRRPVTGLRLFLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKIPGCSVKRSVWDHTPQASQKSGLFSQFGLSTNFTSAHKAKPAPVVLNSAVFPEGPPAPAQNLKLLKFVDVKEMSKGAQDVPGHWLVTGAKLDVDKGKIALRLKYSLLHY

SEQ ID NO: 1080 - protein, 613 aa, Huperzia nummulariifolia (Blume)
MVWAGDQEMAQTDSDRMAAQATAREALQALGRGFDVTLDLRLAYCKGPAGSRLIELDEEKNVDMVIPGGGFVLQGVSRDIRCDKGERTRFRSEVLSFHHMSERFNQALCISGKMPLGLFNAMYNLNGTWQSDASATKSLALDGWFISLYNLQLRKASLTLKEEVKEAVPSVWEPAALARFIDRYGTHIIESVKVGGKDVVYTRQYQSSPLTPGDIQKYLKELADQRFAEGSGQNNVNMRAKEKSLDPFTVTNHAHRLQLASTNTSSSFTAKGDVEVNYKRRGGDNLVRFHGDWLATVPLSPDVVSMSFVPITSLLNGVPGSGFLSHAINLYLRYKPPIEELRSFLEFQIPRQWCPGFDLPLGPQRKEPVCPSLQFSFMGPKLYINTAQVIVGRRPVTGLQLFLEGKKGNRLAIHLQHLSNLPKILQPHWGQHISVGDPVWKQPEEQETKWFEPVQWKSFSHVSTAPIEYGKEDDLIANIVTGAQLQVWDLGAKKVLFLRLLFSKVPGCSIKTSFWDHTPQSSQKSGLFSQLGLSTNFTSARKAKPAAVILNSAIFPEGPPAAVQKLKLLKFVDVKEMSKGAQDVPGHWLVTGAKLDVDKGKIALRVKYSLLHY

SEQ ID NO: 1081 - protein, 570 aa, Huperzia nummulariifolia (Blume)
MRERGIIEFDEEANLDLVIPGGAAIIPNVSRDIRCEKGERKHFRSDVLPFHQMAERFNDALNISGKVPSGFFNSVFSLNGTWQSDASAIKALAVDCWVISLYNMQISKTPQNLKEEVKKAVPPFWEPAALARFIEKYGTHIIMSVKIGGRDVVYIKQYQSSTLSPEEIKRYLREIADQRFAEGSGQGISNMQSKEKSSDPLTSANHAHRLQMANTHTSTSFTAKGDVEVILRRRGGDCMVKHHSDWLATVPFSPDVIAMSFIPITALLNGVPGSGFLSHAIKLYLRYKPPIEELQFFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGLLSQLGLSTTFSSASKAKPAPVVLNSAVFPEGPPVPVQNLKFLKFVDVKEMMKGAQDMPGHWLVTGAKLDVDKGKIALRVKYSLLHY

SEQ ID NO: 1082 - protein, 396 aa, Huperzia phlegmoides
MVWAGDQEMAQTDSDRMAAQATAREALQALGRGFDVTLDLRLAYCKGPPGSCLIELDEEEKSDILIPGGAAIIPDVSRDIKCDKGERTHFSSEVLPFEQMSERFNQALSVPGKVPLGLFNTMFSLNGTWQSDASATKALAVDGWFISLYNMQISKIPLRLKEEVKKAVPPCWEPAALASFIEKYGTHIIMSVKIGGKDVVYIRQYQSSPLSPGEIKRYLKEIADQRFAEGSEQFMLNMRSNEKSPIPLTSTSHAHRLQMANAYTSTSFTTKGDVEVIFRRRGGDCTVKHHSDWLATVPSSPDVVAMTFIPITSLLNEVPGSGLLSHAINLYLRYKPPIEELQFFLEFQIPRQWSPGFDLPIVPQRKEPVCPSLQFSLMGPKVYVSTNQVEAVVSRF

SEQ ID NO: 1083 - protein, 617 aa, Huperzia nummulariifolia (Blume)
MGIDWAGDQMAYREAERTIAQSTAIEALQCLGRGFDVTLDLRLAYCKGPSGSLLVELSEETYPEIVLPGGAVITNVSKDIKCDKGERTHFRSEVLTFHQMSTRFNEALSITGKMPLGLFNTMFSFNGTWQGDASETKALALDGWFITLYNMQITKPELSLNEEVKKAVPSSWEPAALARFIEKYGTHIIVSVKLGGKDVVYLKQYESSLLSSGEVQKYLKVTADQRFSEEAGQNIADTHLKDKLPDPLTSTNHAHRLQTVGNITSSSFTTIKDVEVILRRRGGDSLVKRHNDWLATVSSAPDVVSMSFVAISSLLNGVPGSGFLSHAVNLYLRYKPPIEELQFFLEFQIPKQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGLLSQLGLSTTFSSASKAKPAPVVLNSAVFPEGPPVPVQNLKFLKFVDVKEMMKGAQDMPGHWLVTGAKLDVDKGKIALRVKYSLLHY

SEQ ID NO: 1084 - protein, 614 aa, Huperzia squarrosa
MGMVWAGDQMAYREAERTIAQSTAIEALQCLGRGFDVTLDLRLAYCKGPSGSRLVELSEETYPEIVLPGGVVIPNVSKDIKCDKGERTHFRSEVLPFHQMSTRFNEALSITGKMPLGLFNTMFNFNGTWQGDASETKALALDGWFITLYNMQITKPELSLNEEVKKAVPSSWEPAALARFIEKYGTHIIVSVKLGGKDVVYLKQYESSLLSSGEVQKYLKGIADQRFSEEAGQNISDTRLKDKLPDPLTSTNHAHRLQMASNFTSSSFTTIKDVEVILRRRGGDSLVKHHNDWLATVSSAPDVVSMSFVAISSLLNGVPGSGFLSHAVNLYLRYKPPIEELQFFLEFQIPKQWSPGFDLPFGCQRKEPVYPSLQFSLMGPKVYVSTNQVTVGRRPVTGLRLFLEGKKGNRLAIHLQHLSNLPKILQPHWDQHLPIGLPVWKEPEEQDSKWFEPVQWKSFSHVSTAPIEYRRESYVGETSAVYIVTGAQLRVWDFGLKNVLFLRLLFLKVPGCSVKRTVWDHSPESSQKSGLFPQLGLSTIFSSARKAKPAPVVLNSAVFPEGAVQNLKFLKFVDIKEMTKGAQDMPGHWLVTGAKLDVDKGKIALRVKYSLLHY

SEQ ID NO: 1085 - protein, 615 aa, Huperzia salvinioides
MVWAGDQEMAQTDSDRMAAQATAREALQALGRGFDVTLDLRLAYCKGPPGSCLIELDEEEKSDILIPGGAAIIPDVSRDIKCDKGERTHFSSEVLPFEQMSERFNQALSIPGKVPLGLFNTMFSLNGTWLSDASATKALAVDGWFISLYNMQISKIPLHLKEEVQKAVPPCWEPAALASFIEKYGTHIIMSVKIGGKDVVYIRQYQSSPLSPGEIKRYLKEIAGQRFAEGSEQVMLNMRSNEESPIPLTSHAHRLQMANAYTSASFTTKGDVEVILRRRGGDCMVKHHSDWLATVPFSPDVIAMSFIPITALLNGVPGSGFLSHAIKLYLRYKPPIEELQFFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGLLSQLGLSTTFSSASKAKPAPVVLNSAVFPEGPPVPVQNLKFLKFVDVKEMSKGAQDVPGHWLVTGAKLDVDKGKIALRVKYSLLHY

SEQ ID NO: 1086 - protein, 613 aa, Huperzia phlegmaria
MVWAGHQQMAQKEPGKLAAEVTAREAVQAIGRGFDVTLDLRLAYCKGPAGSRLIELDEEKNVDMVIPGGGFILQGVSRDIRCDKGERTRFRSEVLSFHHMSERFNQALCISGKMPLGLFNAMYNLNGTWQSDASATKSLALDGWFISLYNLQLRKASLTLKEEVKEAVPSVWEPAALARFIDKYGTHIIESVKVGGKDVVYTRQYQSSPLTPGDIQKYLKELADQRFAEGSGQNNVNMRAKEKSLDPFTVTNHAHRLQLASTNTSSSFTAKGDVEVNYKRRGGDNLVRFHGDWLATVPLSPDVVSMSFVPITSLLNGVPGSGFLSHAINLYLRYKPPIEELRSFLEFQIPRQWCPGFDLPLGPQRKEPVCPSLQFSVMGPKLYINTAQVIVGRRPVTGLQLFLEGKKGNRLAIHLQHLSNLPKILQPHWGQHISVGDPVWKQPEEQDTKWFEPVQWKSFSHVSTAPIEYGKEDDLIANIVTGAQLQVWDLGAKKVLFLRLLFSKVPGCSIKTSFWDHTPQSSQKSGLFSQLGLSTNFTSARKAKPAAVILNSAIFPEGPPAAVQKLKLLKFVDVKEMTKGAQDTPGHWLVTGARLDADRGKIALRVKYALLLY

SEQ ID NO: 1087 - protein, 588 aa, Huperzia nummarifolia
MVWAGDQEMAQTEPDRMAAQAIAREALQALGRGFDVTLDLRLAYCKGPSGSRIIEFDEKSNLDLVIPGGAAIIPNVSGDIRCEKGERKHFRSDVLPFHQMAERFNEALNISGKVPLGFFNTMFSLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKDVEVIFRRRGGDCTVKHHSDWLATVPSSPDVMAMTFIPITSLLNEVPGSGFLSHAINLYLRYKPPIEELQFFLEFQIPRQWSPGFDLPIVPQRKEPVCPSLQFSLMGPKIYVSTNQVTVGRRPVTGLRLFLEGKKGNRLAIHLQHLSSLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRSVWDHTPQASQKSGLFSQFGLSTNFTSAHKAKPAPVVLNSAVFPEGPPAPAQNLKLLKFVDVKEMSKGAQDVPGHWLVTGAKLDVDKGKIALRLKYSLLHY

SEQ ID NO: 1088 - protein, 617 aa, Huperzia nummulariifolia (Blume)
MVWAGDQEMAQTDSDRMAAQATAREALQALGRGFDVTLDLRLAYCKGPSGSRIIEFDEEANLDLVIPGGAAIIPNVSRDIRCEKGERKHFRSDVLPFHQMAERFNDALNISGKVPSGFFNSVFSLNGTWQSDASAIKALAVDCWVISLYNMQISKTPQNLKEEVKKAVPPFWEPAALARFIEKYGTHIIMSVKIGGRDVVYIKQYQSSTLSPEEIKRYLREIADQRFAEGSGQGISNMQSKEKSSDPLTSANHAHRLQMANTHTSTSFTAKGDVEVIFRRRGGDCTVKHHSDWLDTVPSSPDVVEMTFIPITSLLNGVPGSGFLSHAIKLYLRYKPPIEELQFFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGLLSQLGLSTTFSSASKAKPAPVVLNSAVFPEGPPVPVQNLKFLKFVDVKEMMKGAQDMPGHWLVTGAKLDVDKGKIALRVKYSLLHY

SEQ ID NO: 1089 - protein, 320 aa, Huperzia phlegmoides
MVWAGDQEMAQTDSDRMAAQATAREALLEFDEEANLDLVIPGGAAIIPNVSGDIRCEKGERTHFISDVLPFHEMAERFNDALNISGKVPLGLFNTMFSFNGTWQSDASATKALAVDCWVISLYNMQISKTPKNLKEEVKKAVPPFWEPAALARFIEKYGTHIIMSVKIGGKDVVYLRQYQSSTLSPEEIKRYLREIADQRFAEGSGHDISNMQSKGQYQSSTLSPEEIKRYLREIADQRFAEGSGQGISNMQSKEKSSDPLTSTNHAHRLQMANTHTSASFTAKGDVEVIFRRRGGDCTVKHHSDWLATVPSSPDVVAMT

SEQ ID NO: 1090 - protein, 617 aa, Huperzia phlegmoides
MVWAGDQEMAQTDSDRMAAQATAREALQALGRGFDVTLDLRLAYCKGPPGSCLIELDEEEKSDILIPGGAAIIPDVSRDIKCDKGERTHFSSEVLPFEQMSERFNQALSVPGKVPLGLFNTMFSLNGTWQSDASATKALAVDGWFISLYNMQISKIPLRLKEEVKKAVPPCWEPAALASFIEKYGTHIIMSVKIGGKDVVYIRQYQSSPLSPGEIKRYLKEIADQRFAEGSEQFMLNMRSNEKSPIPLTSTSHAHRLQMANAYTSTSFTTKGDVEVIFRRRGGDCTVKHHSDWLATVPSSPDVVAMTFIPITSLLNEVPGSGLLSHAINLYLRYKPPIEELQFFLEFQIPRQWSPGFDLPIVPQRKEPVCPSLQFSLMGPKVYVSTNQVTVGRRPVTGLRLFLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGVFSQLGLSTTFSSASKAKPAPVVLNSAVFPEGPPVPVQNLKFLKFVDVKEMMKGAQDMPGHWLVTGAKLDVDKGKIALRVKYSLLHY

SEQ ID NO: 1091 - protein, 616 aa, Huperzia squarrosa
MGMVWAGDQMAYREAERTIAQSTAIEALQCLGRGFDVTLDLRLAYCKGPSGSRLVELSEETYPEIVLPGGVVIPNVSKDIKCDKGERTHFRSEVLPFHQMSTRFNEALSITGKMPLGLFNTMFNFNGTWQGDASETKALALDGWFITLYNMQITKPELSLNEEVKKAVPSSWEPAALARFIEKYGTHIIVSVKLGGKDVVYLKQYESSLLSSGEVQKYLKGIADQRFSEEAGQNISDTRLKDKLPDPLTSTNHAHRLQMASNFTSSSFTTIKDVEVILRRRGGDSLVKHHNDWLATVSSAPDVVSMSFVAISSLLNGVPGSGFLSHAVNLYLRYKPPIEELQFFLEFQIPKQWSPGFDLPFGCQRKEPVYPSLQFSLMGPKVYVSTNQVTVGRRPVTGLRLFLEGKKGNRLAIHLQHLSNLPKILQPHWDQHLPIGLPVWKEPEEQDSKWFEPVQWKSFSHVSTAPLEYLVESYVGEINATYIVTGAQLRVWDFGIKNVLFLRLLFCRVPGCSIKRSFWDHTPQASQKSNLFSQLGLSSTSSARKAKPVPIVLNSAIFPDDPPQSTQTHKLLKFVDIKEMTKGAQDKPGHWLVTGAKLDVDGGKIALGVKYSLLHY

SEQ ID NO: 1092 - protein, 518 aa, Huperzia phlegmaria
MAERFNEALSISGKVPLGLFNTVFSLNGTWQSDASAIKALAVDCWVISLYNMQISRTPKNLKEEVKKAVPPFWEPAALARFIEKYGTHIIMSVKIGGKDVVYLRQYQSSTLSPEEIKRYLREIADQRFAEGSGQGISNMQSKEKSSDPLTSTNHAHRLQMANAHTSASFTAKGDVEVIFRRRGGDCTVKHHSDWLDTVPSSPDVVEMTFIPITSLLNEVPGSGFLSHAIKLYLRYKPPIEELQFFLEFQIPRQWSPGFDLPIVPQRKEPVCPSLQFSLMGPKVYVSTNQVTVGRRPVTGLRLFLEGKKGNRLAIHLQHLSNLPKILQLHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGLFSQLGLSTTFSSASKAKPAPVVLNSAVFPEGPPVPVQNHKFLKFVDVKEMMKGAQDMPGHWLVTGAKLDVDKGKIALRVKYSLLHY

SEQ ID NO: 1093 - protein, 351 aa, Huperzia nummarifolia
MQSKEKDVEVIFRRRGGDCTVKHHSDWLATVPSSPDVMAMTFIPITSLLNEVPGSGFLSHAINLYLRYKPPIEELQFFLEFQIPRQWSPGFDLPIVPQRKEPVCPSLQFSLMGPKIYVSTNQVTVGRRPVTGLRLFLEGKKGNRLAIHLQHLSSLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDRGKIALRVKYSLLHY

SEQ ID NO: 1094 - protein, 617 aa, Huperzia phlegmaria
MVWAGDQEMVQNEPDRMAAQATAREALQALGRGFDVTLDLRLAYCKGPPGSCLIELDEEEKSDILIPGGAAIIPDVSRDIKCDKGERTHFSSEVLPFEQMSERFNQALSIPGKVPLGLFNTMFSLNGTWQSDASATKALAVDGWFISLYNMQLSKIPLRLKEEIIKAVPPCWEPAALASFIEKYGTHIIMSVKIGGKDVVYIRQYQSSPLSPGEIKRYLKEIADQRFAEGSEQFMLNMRSNEESPIPLTSTSHAHRLQMANAYTSASFTTKGDVEVIFRRRGGDCTVKHHSDWLDTVPSSPDVVEMTFIPITSLLNEVPGSGFLSHAIKLYLRYKPPIEELQFFLEFQIPRQWSPGFDLPIVPQRKEPVCPSLQFSLMGPKVYVSTNQVTVGRRPVTGLRLFLEGKKGNRLAIHLQHLSNLPKILQLHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGLFSQLGLSTTFSSASKAKPAPVVLNSAVFPEGPPVPVQNHKFLKFVDVKEMMKGAQDMPGHWLVTGAKLDVDKGKIALRVKYSLLHY

SEQ ID NO: 1095 - protein, 385 aa, Platycerium bifurcatum
MVQNEPDRMAAQATAREAMQALGRGFDVTLDLRLAYCKGPPGSCLIELDEEEKSDILIPGGAAIIPDVSRDIKCDKGERTHFSSEVLPFEQMSERFNQALSIPGKVPLGLFNTMFSLNGTWQSDASATKALAVEGWFISLYNMQISKIPLRLKEEVKKAVPPCWEPAALASFIEKYGTHIITSVKIGGKDVVYIRQYQSSPLSPGEIKSYLKEIADQRFAEGSEQFMLNMRSNEKSPIPLTSTSHAHRLQMANAYTSASFTTKGDVEVILRRRGGDCMVKHHSDWLATVPFSPDVIAMSFIPITALLNGVPGSGFLSHAINLYLRYKPPIEELQFFLEFQIPRLWSPGFDLPLVPQRKEPVCPSLQFSLMGPKIYVSTNQVTVGR

SEQ ID NO: 1096 - protein, 358 aa, Huperzia carinata
MVWAGDQEMVQNEPDRMNAQATAREAMQALGRGFDVTLDLRLAYCKGPPGSCLIELDEEEKSDILIPGGAAIIPDVSRDIKCDKGERTHFSSEVLPFEQMSERFNQALSIPGKVPLGLFNTMFSLNGTWQSDASATKALAVDGWFISLYNMQISKIPLRLKEEVKKAVPPCWEPAALASFIEKYGTHIITSVKIGGKDVVYIRQYQSSPLSPGEIKRYLTEIADQRFAEGSEQFMLNMRSNEKSPIPLTSTSHAHRLQMANTYTSASFTTKGDVEVIFRRRGGDCTVKHHSDWLATVPSSPDVVEMTFIPITSLLNEVPGSGFLSHAIKLYLRYKPPIEELQFFLEFQIPRVWSPGFD

SEQ ID NO: 1097 - protein, 657 aa, Huperzia carriata (Philippines)
MAQTDSDRMAAQATAREALQALGRGFDVTLDLRLAYCKGPSGSRIIEFDEEANLDLVVPGGAAIIPNVSGDIRCEKGERTHFISDVLPFHQMAERFNDALNISGKVPLGFFNTVFSLNGTWQSDASTTKALAVDGWFMSLYNMQISKTPQNLKEEVKKAVPPFWEPAALARFIEKYGTHIIMSVKIGGKDVVYLRQYQSSTLSPGEIKKYLKEIADQRFAEGSGQGISNMQSKEKSSDPVTSANHAHRLQMANTHTSTSFKAKGDVEVIFRRKGGDCTVKHHSDWLATVPSSPDVMSMTFIPITSLLNEVPGSGFLSHAINLYLRYKPPIEELQLFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEPVQWKSFSHVSTAPIEYLQESYIGETSAVYIVTGAQLRVWDFGLKNVLFLRLLFLKVPGCSVKRTVWDHSPESSQKSGLFSQLAVSKTFSSAHKAKPAPVVLKKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDKGKIALRVKYSLLHY

SEQ ID NO: 1098 - protein, 618 aa, Platycerium bifurcatum
MVWAGHQQMAQKEPGKFVAEVTAREAVQAIGRGFDVTLDLRLAYCKGPAGSRLIELDEEKNVDMVIPGGGFVLQGVSRDIRCDKGERTRFRSEVLSFHHMSERFNQALCISGKMPLGLFNSMYNLNGTWQSDASATKSLALDGWFISLYNLQLRKASLTLKEEVKEAVPSVWEPAALARFIDKYGTHIIESVKVGGKDVVYTRQYQSSPLTPGDIQKYLKELADQRFAEGSGQNNVNMRAKEKSLDPFAVTNHAHRLQLASTNTSSSFTAKGDVEVNYKRRGGDNLVRFHGDWLATVPLSPDVISMSFVPITSLLNGVPGSGFLSHAINLYLRYKPPIEELRSFLEFQIPRQWCPGFDLPLGPQRKEPACPSLQFSFMGPKLYINTAQVIVGRRPVTGLQLFLEGKKGNRLAIHLQHLSNLPKILQPHWGQHIAVGPPVWKQPEELDTKWFEPVQWKSFSHVSTAPIEYGKEDDNIANIVTGAQLQVWDLGVWDLGAKKVLFLRLLFSKVPGCSIKTSFWDHTPQSSQKSGLFSQLGLSTNFTSARKAKPAAVILNSAIFPEGPPAAVQKLKLLKFVDVKEMTKGAHDTPGHWLVTGARLDADRGKIALRVKYALLLY

SEQ ID NO: 1099 - protein, 617 aa, Huperzia salvinioides
MVWAGDQEMAQTDSDRMAAQATAREALQALGRGFDVTLDLRLAYCKGPSGSRIIEFDEEANLDLVIPGGAAIIPNVSRDIRCEKGERKHFRSDVLPFHQMAERFNEALNISGKVPLGLFNTMFSFNGTWQSDASAIKALAVDCWVISLYNMQISKTLKNLKEEVKKAVPPFWEPAALARFIEKYGTHIIMSVKIGGRDVVYIKQYQSSTLSPEEIKRYLREIADQRFAEGSGQGISNMQSKEKSSDPLTSANHAHRLQMANTHTSTSFTAKGDVEVILRRRGGDCMVKHHSDWLATVPFSPDVIAMSFIPITALLNGVPGSGFLSHAIKLYLRYKPPIEELQFFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGLLSQLGLSTTFSSASKAKPAPVVLNSAVFPEGPPVPVQNLKFLKFVDVKEMSKGAQDVPGHWLVTGAKLDVDKGKIALRLKYSLLHY

SEQ ID NO: 1100 - protein, 616 aa, Huperzia phlegmaria
MVWAGDQEMVQNEPDRMAAQATAREALQALGRGFDVTLDLRLAYCKGPSGSRIIEFDEEANLDLVIPGGAAIIPNVSRDIRCEKGERKHFRSDVLPFHQMAERFNEALSISGKVPLGLFNTVFSLNGTWQSDASAIKALAVDCWVISLYNMQISRTPKNLKEEVKKAVPPFWEPAALARFIEKYGTHIIMSVKIGGKDVVYLRQYQSSTLSPGEIKKYLKEIADQRFAEGSGHDISNMQSKEKSSDPLTSTNHAHRLQMANAHTSASFTAKGDVEVIFRRRGGDCTVKHHSDWLDTVPSSPDVVEMTFIPITSLLNEVPGSGFLSHAIKLYLRYKPPIEELQFFLEFQIPRQWSPGFDLPIVPQRKEPVCPSLQFSLMGPKVYVSTNQVTVGRRPVTGLRLFLEGKKGNRLAIHLQHLSNLPKILQLHWDQHIPIGLPVWKEPEEQDSKWFEPVQWKSFSHVSTAPLEYLVESYVGEINSTYIVTGAQLRVWDFGIKNVLFLRLLFCRVPGCSIKRSFWDHTPQASQKSNLFSQLGLSSTSSARKAKPVPIVLNSAVYPDDPPTSTQTNKLLKFVDNKEMTKGAQDKPGHWLVTGAKLDVDGGKIALGVKYSLLHY

SEQ ID NO: 1101 - protein, 458 aa, Platycerium bifurcatum
MVWAGDQEMAQTEPDRMAAQAIAREALQALGRGFDVTLDLRLAYCKGPPGSCLIELDEEEKSDILIPGGAAIIPDVSRDIKCDKGERTHFSSEVLPFEQMSERFNQALCISGKMPLGLFNSMYNLGLFNTMFSLNGTWQSDASATKALAVEGWFISLYNMQISKIPLRLKEEVKKAVPPCWEPAALASFIEKYGTHIITSVKIGGKDVVYIRQYQSSPLSPGEIKSYLKEIADQRFAEGSEQFMLNMRSNEKSPIPLTSTSHAHRLQMANAYTSASFTTKGDVEVILRRRGGDCMVKHHSDWLATVPFSPDVIAMSFIPITALLNGVPGSGFLSHAINLYLRYKPPIEELQFFLEFQIPRQWSPGFDLPIVPQRKEPVCPSLQFSLMGPKIYVSTNQVTVGRRPVTGLRLFLEGKKGNRLAIHLQHLSNLPKILQPHWDQHIPIGLPVWKEPEEQDSK

SEQ ID NO: 1102 - protein, 613 aa, Huperzia nummulariifolia (Blume)
MVWAGDQEMAQTDSDRMAAQATAREALQALGRGFDVTLDLRLAYCKGPSGSRIIEFDEEANLDLVIPGGAAIIPNVSRDIRCEKGERKHFRSDVLPFHQMAERFNDALNISGKVPSGFFNSVFSLNGTWQSDASAIKALAVDCWVISLYNMQISKTPQNLKEEVKKAVPPFWEPAALARFIEKYGTHIIMSVKIGGRDVVYIKQYQSSTLSPEEIKRYLREIADQRFAEGSGQGISNMQSKEKSSDPLTSANHAHRLQMANTHTSTSFTAKGDVEVIFRRRGGDCTVKHHSDWLDTVPSSPDVVEMTFIPITSLLNGVPGSGFLSHAIKLYLRYKPPIEELQFFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEPVQWKSFSHVSTAPIEYGKEDDLIANIVTGAQLQVWDLGAKKVLFLRLLFSKVPGCSIKTSFWDHTPQSSQKSGLFSQLGLSTNFTSARKAKPAAVILNSAIFPEGPPAAVQKLKLLKFVDVKEMTKGAQDTPGHWLVTGARLDADRGKIAIRVKYALLLY

SEQ ID NO: 1103 - protein, 449 aa, Platycerium bifurcatum
MVCAGDQEMAQTEPDRMAAQAIAREALQALGRGFDVTLDLRLAYCKGPSGSRIIEFDEKSNLDLVIPGGAAIIPNVSGDIRCEKGERTHFRSDVLPFHEMAERFNDALNISGKVPLGFFNTMFSLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKSSDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRQWSPGFDLPIVPQRKEPVCPSLQFSLMGPKIYVSTNQVTVGRRPVTGLRLFLEGKKGNRLAIHLQHLSNLPKILQPHWDQHIPIGLPVWKEPEEQDSK

SEQ ID NO: 1104 - protein, 475 aa, Platycerium bifurcatum
MAYREAERTIAQSTAIEALQCLGRGFDVTLDLRLAYCKGPSGSLLVELSEETYPEIVLPGGVVITNVSKDIKCDKGERTHFRSEVLTFHQMSTRFNEALSITGKMPLGLFNTMFSFNGTMPLGLFNTMFSFNGTWQGDASETKALALDGWFITLYNMQITKPELSLNEEVKKAVPSSWEPAALARFIEKYGTHIIVSVKLGGKDVVYLKQYESSLLSSGEVQKYLKVIADQRFSEEAGQNISDTHLKDKLPDPLTSTNHAHRLQMASNFTSSSFTTIKDVELIVRRRGGDSLVKRHNDWLATVSSAPDVVSMSFVAISSLLNGVPGSGFLSHAVNLYLRYKPPIEELQFFLEFQIPKQWSPGFDLPLGPQRKGPVCPAMQFSLMGPKLYVCTTQVTVGRRPVTGLRLFLEGKKGNRLTIHLQHLSNLPKILQPHWDQHIAIGPPIWKEPEEHCSMEKLLSCKHCAPGVPGRIICG

SEQ ID NO: 1105 - protein, 617 aa, Huperzia phlegmaria
MVWAGDQEMVQNEPDRMAAQATAREALQALGRGFDVTLDLRLAYCKGPSGSRIIEFDEEANLDLVIPGGAAIIPNVSRDIRCEKGERKHFRSDVLPFHQMAERFNEALSISGKVPLGLFNTVFSLNGTWQSDASAIKALAVDCWVISLYNMQISRTPKNLKEEVKKAVPPFWEPAALARFIEKYGTHIIMSVKIGGKDVVYLRQYQSSTLSPGEIKKYLKEIADQRFAEGSGHDISNMQSKEKSSDPLTSTNHAHRLQMANAHTSASFTAKGDVEVIFRRRGGDCTVKHHSDWLDTVPSSPDVVEMTFIPITSLLNEVPGSGFLSHAIKLYLRYKPPIEELQFFLEFQIPRQWSPGFDLPIVPQRKEPVCPSLQFSLMGPKVYVSTNQVTVGRRPVTGLRLFLEGKKGNRLAIHLQHLSNLPKILQLHWDQHIPIGLPVWKEPEEQDSKWFEHVQWKSFSHVSTAPIEYRRESYVGETSAVYIVTGAQLRVWDFGLKNVLFLRLLFLKVPGCSVKRSVWDHTPQASQKSGLFSQFGLSTNFTSAHKAKPAPVVLNSAVFPEGPPAPAQNLKLLKFVDVKEMSKGAQDVPGHWLVTGAKLDVDKGKIALRLKYSLLHY

SEQ ID NO: 1106 - protein, 305 aa, Huperzia phlegmaria
MVWAGDQEMAQIEPDRMAAQATAREALQALGRGFDVTLDLRLAYCKGPPGSCLIELDEEEKSDILIPGGAAIIPDVSRDIKCDKGERTHFSSEVLPFEQMSERFNQALSIPGKVPLGLFNTMFSLNGTWQSDASATKALAVDGWFISLYNMQLSKIPLRLKEEIIKAVPPCWEPAALARFIFIEKYGTHIIMSVKIGGKDVVYIRQYQSSPLSPGEIKRYLKEIADQRFAEGSEQFMLNMRSNEESPIPLTSTSHAHRLQMANAYTSASFTTKGDVEVIFRRRGGDCTVNTIVIGWILFLLPLMS

SEQ ID NO: 1107 - protein, 620 aa, Huperzia nummarifolia
MVWAGHQQMAQKEPGKVVAEVTAREAVQAIGRGFDVTLDLRLAYCKGPAGSRLIELDEEKNVDMVIPGGGFVLQGVSRDIRCDKGERTRFRSEVLSFHHMSERFNQALCISGKMPLGLFNSMYNLNGTWQSDASATKSLALDGWFISLYNLQLRKASLTLKEEVKEAVPSVWEPAALARFIDKYGTHIIESVKVGGKDVVYTRQYQSSPLTPGDIQKYLKELADQRFAEGSGQNNVNMRAKEKSLDPFAVTNHAHRLQLASTNTSSSFTAKGDVEVNYKRRGGDNLVRFHGDWLATVPLSPDVISMSFVPITSLLNGVPGSGFLSHAINLYLRYKPPIEELRSFLEFQIPRQWCPGFDLPLGPQRKEPACPSLQFSFMGPKLYINTAQVIVGRRPVTGLQLFLEGKKGNRLAIHLQHLSNLPKILQPHWGQHIAVGPPVWKQPEELDTKWFEPVQWKSFSHVSTAPIEYSTAPIEYGKEDDNIANIVTGAQLQVWDLGAKKVLFLRLLFSKVPGCSIKTSFWDHTPQSSQKSGLFSQLGLSTNFTSARKAKPAAVILNSAIFPEGPPAAVQKLKLLKFVDVKEMTKGAHDTPGHWLVTGARLDADRGKIALRVKYALLLY

SEQ ID NO: 1108 - protein, 617 aa, Platycerium bifurcatum
MGIDWAGDQMAYREAERTIAQSTAIEALQCLGRGFDVTLDLRLAYCKGPSGSLLVELSEETYPEIVLPGGVVITNVSKDIKCDKGERTHFRSEVLTFHQMSTRFNEALSITGKMPLGLFNTMFSFNGTWQGDASETKALALDGWFITLYNMQITKPELSLNEEVKKAVPSSWEPAALARFIEKYGTHIIVSVKLGGKDVVYLKQYESSLLSSGEVQKYLKVIADQRFSEEAGQNISDTHLKDKLPDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRLWSPGFDLPLVPQRKEPVCPSLQFSLMGPKIYVSTNQVTVGRRPVTGLRLFLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDKGKIALRVKYSLLHY

SEQ ID NO: 1109 - protein, 538 aa, Huperzia goebelii (Holub)
MQISKTPKNLKEEVKKAVPPFWEPAALARFIEKYGTHIIMSVKIGGRDVVYIKQYQSSTLSPEEIKRYLREIADQRFAEGSGQGISNMQSKEKSSDLLTLSPEEIKRYLREIADQRFAEGSGQGISNMQSKEKSSDLLTSANHAHRLQMANTHTSTSFTAKGDVEVIFRRRGGDCTVKHHSDWLATVPSSPDVMSMTFIPITSLLNEVPGSGFLSHAINLYLRYKPPIEELQFFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGLFSQLGLSTTFSSASKAKPVPVVLNSAVFPEGPPVPVQNLKFLKFVDVKEMMKGAQDMPGHWLVTGAKLDVDKGKIALRVKYSLLHY

SEQ ID NO: 1110 - protein, 342 aa, Platycerium bifurcatum
MAAQAIAREALQALGRGFDVTLDLRLAYCKGPPGSCLIELDEEEKSDILIPGGAAIIPDVSRDIKCDKGERTHFSSEVLPFEQMSERFNQALCISGKMPLGLFNTMFSLNGTWQSDASATKALAVEGWFISLYNMQISKIPLRLKEEVKKAVPPCWEPAALASFIEKYGTHIITSVKIGGKDVVYIRQYQSSPLSPGEIKSYLKEIADQRFAEGSEQFMLNMRSNEKSPIPLTSTSHAHRLQMANAYTSASFTTKGDVEVILRRRGGDCMVKHHSDWLATVPFSPDVIAMSFIPITALLNGVPGSGFLSHAINLYLRYKPPIEELQFFLEFQIPRQWSPGFD

SEQ ID NO: 1111 - protein, 639 aa, Huperzia carriata (Philippines)
MGIDWAGDQMAYREAERTIAQSTAIEALQCLGRGFDVTLDLRLAYCKGPSGSLLVELSEETYPEIVLPGGVVITNVSKDIKCDKGERTHFRSEVLTFHQMSTRFNEALSITGKMPLGLFNTMFSFNGTWQGDASETKALALDGWFITLYNMQITKPELSLNEEVKKAVPSSWEPAALARFIEKYGTHIIVSVKLGGKDVVYLKQYESSLLSSGEVQKYLKVIADQRFSEEAGQNISDTHLNLKVIADQRFSEEAGQNISDTHLKDKLPDPLTSTNHAHRLQMASNFTSSSLTTIKDVEVIVRRRGGDSLVKRHNDWLATVSSAPDVVSMSFVAISSLLNGVPGSGFLSHAVNLYLRYKPPIEELQFFLEFQIPKQWSPGFDLPLGPQRKGPVCPAMQFSLMGPKLYVCTTQVTVGRRPVTGLRLFLEGKKGNRLTIHLQHLSNLPKILQPHWDQHIAIGPPIWKEPEEQDSKWFEPVQWKSFSHVSTAPLEYLVESYVGEINSTYIVTGAQLRVWDFGIKNVLFLRLLFCRVPGCSIKRSFWDHTPQASQKSNLFSQLGLSSISSARKAKPVPIVLNSAVFPDDPPQSTQTHKLLKFVDIKEMTKGAQDKPGHWLVTGAKLDVDGGKIALGVKYSLLHY

SEQ ID NO: 1112 - protein, 609 aa, Huperzia carriata (Philippines)
MAQTDSDRMAAQATAREALQALGRGFDVTLDLRLAYCKGPSGSRIIEFDEEANLDLVVPGGAAIIPNVSGDIRCEKGERTHFISDVLPFHQMAERFNDALNISGKVPLGFFNTVFSLNGTWQSDASTTKALAVDGWFMSLYNMQISKTPQNLKEEVKKAVPPFWEPAALARFIEKYGTHIIMSVKIGGKDVVYLRQYQSSTLSPGEIKKYLKEIADQRFAEGSGQGISNMQSKEKSSDPVTSANHAHRLQMANTHTSTSFKAKGDVEVIFRRKGGDCTVKHHSDWLATVPSSPDVMSMTFIPITSLLNEVPGSGFLSHAINLYLRYKPPIEELQLFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEHVQWKSFSHVSTAPIEYRRESYVGETSAVYIVTGAQLRVWDFGLKNVLFLRLLFLKVPGCSVKRSVWDHTPQASQKSGLFSQFGLSTNFTSAHKAKPAPVVLNSAVFPEGPPAPAQNLKLLKFVDVKEMSKGAQDVPGHWLVTGAKLDVDKGKIALRVKYSLLHY

SEQ ID NO: 1113 - protein, 455 aa, Huperzia nummarifolia
MVWAGDQEMVQNEPDRMAAQAIAREALQALGRGFDVTLDLRLAYCKGPPGSCLIELDEEEKSDILIPGGAAIIPDVSRDIKCDKGERTHFSSEVLPFEQMSERFNQALCISGKMPLGLFNSMYNLNGTWQSDASATKALAVEGWFISLYNMQISKIPLRLKEEVKKAVPPCWEPAALASFIEKYGTHIITSVKIGGKDVVYIRQYQSSPLSPGEIKRYLKEIADQRFAEGSEQFMLNMRSNEKSPIPLTSTSHAHRLQMANAYTSASFTTKGDVEVILRRRGGDCMVKHHSDWLATVPFSPDVIAMSFIPITALLNGVPGSGFLSHAINLYLRYKPPKLFLEFQIPRQWSPGFDLPIVPQRKEPVCPSLQFSLMGPKIYVSTNQVTVGRRPVTGLRLFLEGKKGNRLAYNICLIFLKSFNHIGINIYQLDFLSGRNLKSKIANGLNLFNGKASLM

SEQ ID NO: 1114 - protein, 303 aa, Huperzia phlegmaria
MVWAGDQEMAQIEPDRMAAQATAREALQALGRGFDVTLDLRLAYCKGPSGSRIIEFDEEANLDLVIPGGVAIIPNVSGDIRCEKGERTHFISDVLSFHQMAERFNEALNISGKVPSGFFNTVFSLNGTWQSDASATKALAVDGWFISLYNMQLSKIPLRLKEEIIKAVPPCWEPAALASFIEKYGTHIIMSVKIGGKDVVYIRQYQSSPLSPGEIKRYLKEIADQRFAEGSEQFMLNMRSNEESPIPLTSTSHAHRLQMANAYTSASFTTKGDVEVIFRRRGGDCTVKHHSDWLDLFLLPLMS

SEQ ID NO: 1115 - protein, 305 aa, Huperzia phlegmaria
MVWAGDQEMAQIEPDRMAAQATAREALQALGRGFDVTLDLRLAYCKGPPGSCLIELDEEEKSDILIPGGAAIIPDVSRDIKCDKGERTHFSSEVLPFEQMSERFNQALSIPGKVPLGLFNTMFSLNGTWQSDASATKALAVDGWFISLYNMQLSKIPLRLKEEIIKAKAVPPCWEPAALASFIEKYGTHIIMSVKIGGKDVVYIRQYQSSPLSPGEIKRYLKEIADQRFAEGSEQFMLNMRSNEESPIPLTSTSHAHRLQMANAYTSASFTTKGDVEVIFRRRGGDCTVNTIVIGWILFLLPLMS

SEQ ID NO: 1116 - protein, 295 aa, Platycerium bifurcatum
MVWAGDQEMVQNEPDRMAAQAIAREALQALGRGFDVTLDLRLAYCKGPPGSCLIELDEEEKSDILIPGGAAIIPDVSRDIKCDKGERTHFSSEVLPFEQMSERFNQALCISGKMPLGLFNSMYNLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKDVEVIFRRRGGDCTVKHHSDWLATVPSSPDVMAMTFIPITSLLNEVPGSGFL

SEQ ID NO: 1117 - protein, 287 aa, Huperzia phlegmaria
MAAQATAREALQALGRGFDVTLDLRLAYCKGPSGSRIIEFDEEANLDLVIPGGAAIIPNVSGDIRCEKGERTHFISDVLSFHQMAERFNEALNISGKVPSGFFNTVFSLNGTWQSDASAIKALAVDCWVISLYNMQISRTPKNLKEEVKKAVPPFWEPAALARFIEKYGTHIIMSVKIGGKDVVYLRQYQSSTLSPGEIKKYLKEIADQRFAEGSGHDISNMQSKEKSSDPLTSTNHAHRLQMANAHTSASFTAKGDVEVIFRRRGGDCTVNTIVIGWILFLLPLMS

SEQ ID NO: 1118 - protein, 367 aa, Huperzia nummulariifolia (Blume)
MVWAGHQQMAQKEPGKLAAEVTAREAVQAIGRGFDVTLDLRLAYCKGPSGSRIIEFDEEANLDLVIPGGAAIIPNVSRDIRCEKGERKHFRSDVLPFHQVPGGAAIIPNVSRDIRCEKGERKHFRSDVLPFHQMAERFNDALNISGKVPSGFFNSVFSLNGTWQSDASAIKALAVDCWVISLYNMQISKTPQNLKEEVKKAVPPFWEPAALARFIEKYGTHIIMSVKIGGRDVVYIKQYQSSTLSPEEIKRYLREIADQRFAEGSGQGISNMQSKEKSSDPLTSANHAHRLQMANTHTSTSFTAKGDVEVIFRRRGGDCTVKHHSDWLDTVPSSPDVVEMTFIPITSLLNGVPGSGFLSHAIKLYLR

SEQ ID NO: 1119 - protein, 514 aa, Platycerium bifurcatum
MSERFNQALCISGKMPLGLFNSMYNLNGTWQSDASATKSLALDGWFISLYNLQLRKASLTLKEEVKEAVPSVWEPAALARFIDKYGTHIIESVKVGGKDVVYTRQYQSSPLTPGDIQKYLKELADQRFAEGSGQNNVNMRAKEKSLDPFAVTNHAHRLQLASTNTSSSFTAKGDVEVNYKRRGGDNLVRFHGDWLATVPLSPDVISMSFVPITSLLNGVPGSGFLSHAINLYLRYKPPIEELRSFLEFQIPRQWCPGFDLPLGPQRKEPACPSLQFSFMGPKLYINTAQVIVGRRPVTGLQLFLEGKKGNRLAIHLQHLSNLPKILQPHWGQHIAVGPPVWKQPEELDTKWFEPVQWKSFSHVSTAPIEYGKEDDNIANIVTGAQLQVWDLGAKKVLFLRLLFSKVPGCSIKTSFWDHTPQSSQKSGLFSQLGLSTNFTSARKAKPAAVILNSAIFPEGPPAAVQKLKLLKFVDVKEMTKGAHDTPGHWLVTGARLDADRGKIALRVKYALLLY

SEQ ID NO: 1120 - protein, 329 aa, Huperzia nummulariifolia
MVWAGDQEMAQTEPDRMAAQAIAREALQALGRGFDVTLDLRLAYCKGPSGSHIIEFDEEANLDLVIPGGAAIIPNVSGDIRCEKGERTHFRSDVLPFHEMAERFNDALNISGKVPLGFFNTMFSLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKDVEVIFRRRGGDCTVKHHSDWLATVPSSPDVMAMTFIPITSLLNEVPGSGFLSHAINLYLRYKPPIEELQFFLEFQIPRQWSPGFD

SEQ ID NO: 1121 - protein, 303 aa, Huperzia phlegmaria
MVWAGDQEMAQADSDRMAAQATAREALQALGRGFDVTLDLRLAYCKGPSGSRIIEFDEEANLDLVIPGGVAIIPNVSGDIRCEKGERTHFISDVLSFHQMAERFNEALNISGKVPSGFFNTVFSLNGTWQSDASAIKALAVDCWVISLYNMQISRTPKNLKEEVKKAVPPFWEPAALARFIEKYGTHIIMSVKIGGKDVVYLRQYQSSTLSPGEIKKYLKEIADQRFAEGSGHDISNMQSKEKSSDPLTSANHAHRLQMANTHTSTSFTAKGDVEVIFRRRGGDCTVKHHSDWLDLFLLPLMS

SEQ ID NO: 1122 - protein, 617 aa, Platycerium bifurcatum
MGIDWAGDQMAYREAERTIAQSTAIEALQCLGRGFDVTLDLRLAYCKGPSGSLLVELSEETYPEIVLPGGVVITNVSKDIKCDKGERTHFRSEVLTFHQMSTRFNEALSITGKMPLGLFNTMFSFNGTWQGDASETKALALDGWFITLYNMQITKPELSLNEEVKKAVPSSWEPAALARFIEKYGTHIIVSVKLGGKDVVYLKQYESSLLSSGEVQKYLKVIADQRFSEEAGQNISDTHLKDKLPDPLTSTNHAHRLQMASNFTSSSFTTIKDVELIVRRRGGDSLVKRHNDWLATVSSAPDVVSMSFVAISSLLNGVPGSGFLSHAVNLYLRYKPPIEELQFFLEFQIPKLWSPGFDLPLGPQRKGPVCPAMQFSLMGPKLYVCTTQVTVGRRPVTGLRLFLEGKKGNRLTIHLQHLSNLPKILQPHWDQHIAIGPPIWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDKGKIALRVKYSLLHY

SEQ ID NO: 1123 - protein, 617 aa, Huperzia phlegmaria
MVWAGDQEMAQADSDRMAAQATAREALQALGRGFDVTLDLRLAYCKGPSGSRIIEFDEEANLDLVIPGGAAIIPNVSRDIRCEKGERKHFRSDVLPFHQMAERFNEALSISGKVPLGLFNTVFSLNGTWQSDASAIKALAVDCWVISLYNMQISRTPKNLKEEVKKAVPPFWEPAALARFIEKYGTHIIMSVKIGGKDVVYLRQYQSSTLSPGEIKKYLKEIADQRFAEGSGHDISNMQSKEKSSDPLTSTNHAHRLQMANAHTSASFTAKGDVEVIFRRRGGDCTVKHHSDWLDTVPSSPDVVEMTFIPITSLLNEVPGSGFLSHAIKLYLRYKPPIEELQFFLEFQIPRQWSPGFDLPIVPQRKEPVCPSLQFSLMGPKVYVSTNQVTVGRRPVTGLRLFLEGKKGNRLAIHLQHLSNLPKILQLHWDQHIPIGLPVWKEPEEQDSKWFEHVQWKSFSHVSTAPIEYRRESYVGETSAVYIVTGAQLRVWDFGLKNVLFLRLLFLKVPGCSVKRSVWDHTPQASQKSGLFSQFGLSTNFTSAHKAKPAPVVLNSAVFPEGPPAPAQNLKLLKFVDVKEMSKGAQDVPGHWLVTGAKLDVDKGKIALRLKYSLLHY

SEQ ID NO: 1124 - protein, 616 aa, Huperzia phlegmaria
MGIDWAGDQMAYREAERTIAQSTAIEALQCLGRGFDVTLDLRLAYCKGPSGSLLVELSEETYPEIVLPGGVVITNVSKDIKCDKGERTHFRSEVLTFHQMSTRFNEALSITGKMPLGLFNTMFSFNGTWQGDASETKALALDGWFITLYNMQITKPELSLNEEVKKAVPSSWEPAALARFIEKYGTHIIVSVKLGGKDVVYLKQYESSLLSSAEVQKYLKVTADQRFSEEAGLNISDTHLKDKLPDPLTSTNHAHRVPTASNFTSSSFTTIKDVEVILRRRGGDSLVKRHNDWLATVSSAPDVVSMSFVAISSLLNGVPGSGFLSHAVNLYLRYKPPIEELQFFLEFQIPKQWSPGFDLPLGPQRKGPVCPALQFSLMGPKLYVCTTQVTVGRRPVTGLRLFLEGKKGNRLTIHLQHLSNLPKILQPHWDQHIAIGPPIWKEPEEQDSKWFEPVQWKSFSHVSTAPLEYLVESYVGEINSTYIVTGAQLRVWDFGIKNVLFLRLLFCRVPGCSIKRSFWDHTPQASQKSNLFSQLGLSSTSSARKAKPVPIVLNSAVYPDDPPTSTQTNKLLKFVDNKEMTKGAQDKPGHWLVTGAKLDVDGGKIALGVKYSLLHY

SEQ ID NO: 1125 - protein, 613 aa, Huperzia phlegmaria
MVWAGHQQMAQKEPGKLAAEVTAREAVQAIGRGFDVTLDLRLAYCKGPAGSRLIELDEEKNVDMVIPGGGFILQGVSRDIRCDKGERTRFRSEVLSFHHMSERFNQALCISGKMPLGLFNSMYNLNGTWQSDASATKSLALDGWFISLYNLQLRKASLTLKEEVKEAVPSVWEPAALARFIDKYGTHIIESVKVGGKDVVYTRQYQSSPLTPGDIQKYLKELADQRFAEGSGQNNVNMRAKEKSLDPFTVTNHAHRLQLASTNTSSSFTAKGDVEVNYKRRGGDNLVRFHGDWLATVPLSPDVVSMSFVPITSLLNGVPGSGFLSHAINLYLRYKPPIEELRSFLEFQIPRQWCPGFDLPLGPQRKEPVCPSLQFSFMGPKLYINTAQVIVGRRPVTGLQLFLEGKKGNRLAIHLQHLSNLPKILQPHWGQHISVGDPVWKQPEEQDTKWFEPVQWKSFSHVSTAPIEYGKEDDLIANIVTGAQLQVWDLGAKKVLFLRLLFSKVPGCSIKTSFWDHTPQSSQKSGLFSQLGLSTNFTSARKAKPAAVILNSAIFPEGPPAAVQKLKLLKFVDVKEMTKGAQDTPGHWLVTGARLDADRGKIALRVKYALLLY

SEQ ID NO: 1126 - protein, 617 aa, Platycerium bifurcatum
MGIDWAGDQMAYREAERTIAQSTAIEALQCLGRGFDVTLDLRLAYCKGPSGSLLVELSEETYPEIVLPGGVVITNVSKDIKCDKGERTHFRSEVLTFHQMSTRFNEALSITGKVPLGLFNTMFSLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKSSDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRLWSPGFDLPLVPQRKEPVCPSLQFSLMGPKIYVSTNQVTVGRRPVTGLRLFLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDKGKIALRVKYSLLHY

SEQ ID NO: 1127 - protein, 588 aa, Huperzia nummarifolia
MVWAGDQEMVQNEPDRMAAQAIAREALQALGRGFDVTLDLRLAYCKGPSGSRIIEFDEKSNLDLVIPGGAAIIPNVSGDIRCEKGERKHFRSDVLPFHQMAERFNEALNISGKVPLGFFNTMFSLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKDVEVIFRRRGGDCTVKHHSDWLATVPSSPDVMAMTFIPITSLLNEVPGSGFLSHAINLYLRYKPPIEELQFFLEFQIPRQWSPGFDLPIVPQRKEPVCPSLQFSLMGPKIYVSTNQVTVGRRPVTGLRLFLEGKKGNRLAIHLQHLSSLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDRGKIALRVKYSLLHY

SEQ ID NO: 1128 - protein, 403 aa, Huperzia tetratoides
MVSAGHRQMAQKEPGKLAAEVTAREAVQAIGRGFDVTLDLRLAYCKGPAGSRLIELDEEKNVDMVIPGGGFVLRGVSRDIRCDKGERTRFRSEVLSFHHMSERFNQALSISGKMPLGLFNTMYSLNGTWQSDASATKSLALDGWFISLYNLQLRKASLTLKEEVKEAVPSVWEPAALARFIDKYGTHIIESVKVGGKDVVYTRQYQSSPLTSGDIQKYLKELADQRFAEGSGTNNVNMRAKEKSPDPFTVTNHAHRLQLASTNTSSSFTAKGDVEVNFKRRGGDNLVRFHGDWLATVPLSPDVISMSFVPITSLLNGVPGSGFLSHAVNLYLRYKPPIEELRSFLEFQIPRQWSPGFDLPLGPQRKEPACPSLQFSFMGPKLYINTAQVIVGRRPVTGLQLRF

SEQ ID NO: 1129 - protein, 518 aa, Huperzia phlegmaria
MSERFNQALSIPGKVPLGLFNTMFSLNGTWQSDASATKALAVDGWFISLYNMQLSKIPLRLKEEIIKAVPPCWEPAALASFIEKYGTHIIMSVKIGGKDVVYIRQYQSSPLSPGEIKRYLKEIADQRFAEGSEQFMLNMRSNEESPIPLTSTSHAHRLQMANAYTSASFTTKGDVEVIFRRRGGDCTVKHHSDWLDTVPSSPDVVEMTFIPITSLLNEVPGSGFLSHAIKLYLRYKPPIEELQFFLEFQIPRQWSPGFDLPIVPQRKEPVCPSLQFSLMGPKVYVSTNQVTVGRRPVTGLRLFLEGKKGNRLAIHLQHLSNLPKILQLHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGLFSQLGLSTTFSSASKAKPAPVVLNSAVFPEGPPVPVQNHKFLKFVDVKEMMKGAQDMPGHWLVTGAKLDVDKGKIALRVKYSLLHY

SEQ ID NO: 1130 - protein, 617 aa, Huperzia phlegmaria
MVWAGDQEMVQNEPDRMAAQATAREALQALGRGFDVTLDLRLAYCKGPSGSRIIEFDEEANLDLVIPGGAAIIPNVSRDIRCEKGERKHFRSDVLPFHQMAERFNEALSISGKVPLGLFNTVFSLNGTWQSDASAIKALAVDCWVISLYNMQISRTPKNLKEEVKKAVPPFWEPAALARFIEKYGTHIIMSVKIGGKDVVYLRQYQSSTLSPEEIKRYLREIADQRFAEGSGQGISNMQSKEKSSDPLTSTNHAHRLQMANAHTSASFTAKGDVEVIFRRRGGDCTVKHHSDWLDTVPSSPDVVEMTFIPITSLLNEVPGSGFLSHAIKLYLRYKPPIEELQFFLEFQIPRQWSPGFDLPIVPQRKEPVCPSLQFSLMGPKVYVSTNQVTVGRRPVTGLRLFLEGKKGNRLAIHLQHLSNLPKILQLHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGLFSQLGLSTTFSSASKAKPAPVVLNSAVFPEGPPVPVQNHKFLKFVDVKEMMKGAQDMPGHWLVTGAKLDVDKGKIALRVKYSLLHY

SEQ ID NO: 1131 - protein, 668 aa, Platycerium bifurcatum
MVWAGDQEMAQTEPDRMAAQAIAREALQALGRGFDVTLDLRLAYCKGPSGSRIIEFDEKSNLDLVIPGGAAIIPNVSGDIRCEKGERTHFRSDVLPFHEMAERFNDALNISGKVPLGFFNTMFSLNGTWQSDASATKALAVDCWVISLYNMQIFKTPKNLKEEVKKAVPPFWEPAALARFIAATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGGSGHDISNMQSKEKSSDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRQWSPGFDLPIVPQRKEPVCPSLQFSLMGPKIYVSTNQVTVGRRPVTGLRLFLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGLFSQLGLSTTFSSASKARPAPVVLNSTVFPEGPPVPVQNLKFLKFVDVKEMMKGAQDMPGHWLVTGAKLDVDKGKIALRVKYSLLHY

SEQ ID NO: 1132 - protein, 358 aa, Platycerium bifurcatum
MVCAGDQEMAQTEPDRMAAQAIAREALQALGRGFDVTLDLRLAYCKGPSGSRIIEFDEKSNLDLVIPGGAAIIPNVSGDIRCEKGERTHFRSDVLPFHEMAERFNDALNISGKVPLGFFNTMFSLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKSSDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRQWSPGFD

SEQ ID NO: 1133 - protein, 285 aa, Platycerium bifurcatum
MAERFNDALNISGKVPLGFFNTMFSLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKSSDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRLWSPGFDLPLVPQRKEPVCPSLQFSLMGVVSRF

SEQ ID NO: 1134 - protein, 560 aa, Huperzia tetratoides
MSERFNQALSISGKMPLGLFNTMYSLNGTWQSDASATKSLALDGWFISLYNLQLRKASLTLKEEVKEAVPSVWEPAALARFIDKYGTHIIESVKVGGKDVVYTRQYQSSPLTSGDIQKYLKELADQRFAEGSGTNNVNMRAKEKSPDPFTVTNHAHRLQLASTNTSSSFTAKGDVEVNFKRRGGDNLVRFHGDWLATVPLSPDVISMSFVPITSLLNGVPGSGFLSHAVNLYLRYKPPIEELRSFLEFQIPRQWSPGFDLPLGPQRKEPACPSLQFSFMGPKLYINTAQVIVGRRPVTGLQLFLEGKKGNRLAIHLQHLSNLPKILQPHWGQHISVGPPVWKQPEEQDTKWFEPVQWKSFSHVSLSNLPKILQPHWGQHISVGPPVWKQPEEQDTKWFEPVQWKSFSHVSTAPIEYGKEDDLIANIVTGAQLQVWELGAKKVLFLRLLFSKVPGCSIKTSFWDHTPQSSQKSGLFSQLGLSTNFTSARKAKPAAVILNSAIFPEGPPAAVQKLKLLKFVDVKEMTKGAHDTPGHWLVTGARLDADRGKIALRVKYALLLY

SEQ ID NO: 1135 - protein, 657 aa, Huperzia carriata (Philippines)
MAQTDSDRMAAQATAREALQALGRGFDVTLDLRLAYCKGPSGSRIIEFDEEANLDLVVPGGAAIIPNVSGDIRCEKGERTHFISDVLPFHQMAERFNDALNISGKVPLGFFNTVFSLNGTWQSDASTTKALAVDGWFMSLYNMQISKTPQNLKEEVKKAVPPFWEPAALARFIEKYGTHIIMSVKIGGKDVVYLRQYQSSTLSPGEIKKYLKEIADQRFAEGSGQGISNMQSKEKSSDPVTSANHAHRLQMANTHTSTSFKAKGDVEVIFRRKGGDCTVKHHSDWLATVPSSPDVMSMTFIPITSLLNEVPGSGFLSHAINLYLRYKPPIEELQLFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEPVQWKSFSHVSTAPIEYLQESYIGETSAVYIVTGAQLRVWDFGLKNVLFLRLLFLKVPGCSVKRTVWDHSPESSQKSGLFSQLAVSKTFSSAHKAKPAPVVLKKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDKGKIALRLKYSLLHY

SEQ ID NO: 1136 - protein, 552 aa, Huperzia phlegmaria
MGIDWAGDQMAYREAERTIAQSTAIEALQCLGRGFDVTLDLRLAYCKGPSGSLLVELSEETYPEIVLPGGVVITNVSKDIKCDKGERTHFRSEVLTFHQMSTRFNEALSITGKMPLGLFNTMFSFNGTWQGDASETKALALDGWFITLYNMQITKPELSLNEEVKKAVPSSWEPAALARFIEKYGTHIIVSVKLGGKDVVYLKQYESSLLSSAEVQKYLKVTADQRFSEEAGLNISDTHLKDKLPDPLTSTNHAHRVPTASNFTSSSFTTIKDVEVILRRRGGDSLVKRHNDWLATVSSAPDVVSMSFVAISSLLNGVPGSGFLSHAVNLYLRYKPPIEELQFFLEFQIPKQWSPGFDLPLGPQRKGPVCPALQFSLMGPKLYVCTTQVTVGRRPVTGLRLFLEGKKGNRLTIHLQHLSNLPKILQPHWDQHIAIGPPIWKEPEEQDSKWFEPVQWKSFSHVSTAPLEYLVESYVGEINSTYIVTGAQLRVWDFGIKNVLFLRLLFCRVPGCSIKRSFWDHTPQASQKSNLFSQLGLSSTSSAQTDLTVRIN

SEQ ID NO: 1137 - protein, 423 aa, Platycerium bifurcatum
MFSLNGTWQSDASATKALAVEGWFISLYNMQISKIPLRLKEEVKKAVPPCWEPAALASFIEKYGTHIITSVKIGGKDVVYIRQYQSSPLSPGEIKSYLKEIADQRFAEGSEQFMLNMRSNEKSPIPLTSTSHAHRLQMANAYTSASFTTKGDVEVILRRRGGDCMVKHHSDWLATVPFSPDVIAMSFIPITALLNGVPGSGFLSHAINLYLRYKPPIEELQFFLEFQIPRQWSPGFDLPIVPQRKEPVCPSLQFSLMGPKIYVSTNQVTVGRRPVTGLRLFLEGKKGNRLAIHLQHLSNLPKILQPHWDQHIPIGLPVWKEPEEQDSKWFEPVQWKSFSHLGLSTTFSSASKARPAPVVLNSTVFPEGPPVPVQNLKFLKFVDVKEMMKGAQDMPGHWLVTGAKLDVDKGKIALRLKYSLLHY

SEQ ID NO: 1138 - protein, 335 aa, Huperzia carinata
MVWAGDQEMVQNEPDRMNAQATAREAMQALGRGFDVTLDLRLAYCKGPPGSCLIELDEEEKSDILIPGGAAIIPDVSRDIKCDKGERTHFSSEVLPFEQMSERFNQALSIPGKVPLGLFNTMFSLNGTWQSDASATKALAVDGWFISLYNMQISKIPLRLKEEVKKAVPPCWEPAALASFIEKYGTHIITSVKIGGKDVVYIRQYQSSPLSPGEIKRYLTEIADQRFAEGSEQFMLNMRSNEKSPIPLTSTSHAHRLQMANTYTSASFTTKGDVEVIFRRRGGDCTVKHHSDWLATVPSSPDVVEMTFIPITSLLNEVPGSGFLSHAINLYLSSI

SEQ ID NO: 1139 - protein, 617 aa, Huperzia phlegmaria
MVWAGDQEMAQADSDRMAAQATAREALQALGRGFDVTLDLRLAYCKGPSGSRIIEFDEEANLDLVIPGGAAIIPNVSRDIRCEKGERKHFRSDVLPFHQMAERFNEALSISGKVPLGLFNTVFSLNGTWQSDASAIKALAVDCWVISLYNMQISRTPKNLKEEVKKAVPPFWEPAALARFIEKYGTHIIMSVKIGGKDVVYLRQYQSSTLSPGEIKKYLKEIADQRFAEGSGHDISNMQSKEKSSDPLTSTNHAHRLQMANAHTSASFTAKGDVEVIFRRRGGDCTVKHHSDWLDTVPSSPDVVEMTFIPITSLLNEVPGSGFLSHAIKLYLRYKPPIEELQFFLEFQIPRQWSPGFDLPIVPQRKEPVCPSLQFSLMGPKVYVSTNQVTVGRRPVTGLRLFLEGKKGNRLAIHLQHLSNLPKILQLHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGLFSQLGLSTTFSSASKAKPAPVVLNSAVFPEGPPVPVQNHKFLKFVDVKEMMKGAQDMPGHWLVTGAKLDVDKGKIALRVKYSLLHY

SEQ ID NO: 1140 - protein, 356 aa, Huperzia carinata
MVWAGDQEMVQNEPDRMNAQATAREAMQALGRGFDVTLDLRLAYCKGPSGSHLIEFDEEANLDLVIPGGAAIIPNVSRDIRCEKGERKHFRSDVLPFHQMAERFNEALNISGKVPLGLFNTMFSFNGTWQSDASATKALAVDCWVISLYNMQISKTPKNLKEEVKKAVPPFWEPAALARFIEKYGTHIIMSVKIGGRDVVYIKQYQSSTLSPEEIKRYLREIADQRFAEGSGQGISNMQSKEKSSDPVTSANHAHRLQMANTHTSTSFKAKGDVEVIFRRKGGDCTVKHHSDWLATVPSSPDVVEMTFIPITSLLNEVPGSGFLSHAIKLYLRYKPPIEELQFFLEFQIPRVVSRF

SEQ ID NO: 1141 - protein, 609 aa, Huperzia carriata (Philippines)
MAQTDSDRMAAQATAREALQALGRGFDVTLDLRLAYCKGPPGSCLIELDEEEKSDILIPGGAAIIPDVSRDIKCDKGERTHFSSEVLPFEQMSERFNQALSIPGKVPLGLFNTMFSLNGTWQSDASTTKALAVDGWFMSLYNMQISKTPQNLKEEVKKAVPPFWEPAALARFIEKYGTHIIMSVKIGGKDVVYLRQYQSSTLSPGEIKKYLKEIADQRFAEGSGQGISNMQSKEKSSDPVTSANHAHRLQMANTYTSASFTTKGDVEVIFRRRGGDCTVKHHSDWLATVPSSPDVMSMTFIPITSLLNEVPGSGFLSHAINLYLRYKPPIEELQLFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEPVQWKSFSHVSTAPIEYLQESYIGETSAVYIVTGAQLRVWDFGLKNVLFLRLLFLKVPGCSVKRTVWDHSPESSQKSGLFSQLAVSKTFSSAHKAKPAPVVLNSAVLPEGPHVPVQSLKFLKFVDVKEMMKGAQDMPGHWLVTGAKLDVDKGKIALRVKYSLLHY

SEQ ID NO: 1142 - protein, 627 aa, Huperzia phlegmaria
MKERIYHYSSHMGIDWAGDQMAYREAERTIAQSTAIEALQCLGRGFDVTLDLRLAYCKGPSGSLLVELSEETYPEIVLPGGVVITNVSKDIKCDKGERTHFRSEVLTFHQMSTRFNEALSITGKMPLGLFNTMFSFNGTWQGDASETKALALDGWFITLYNMQITKPELSLNEEVKKAVPSSWEPAALARFIEKYGTHIIVSVKLGGKDVVYLKQYESSLLSSAEVQKYLKVTADQRFSEEAGLNISDTHLKDKLPDPLTSTNHAHRVPTASNFTSSSFTTIKDVEVILRRRGGDSLVKRHNDWLATVSSAPDVVSMSFVAISSLLNGVPGSGFLSHAVNLYLRYKPPIEELQFFLEFQIPKQWSPGFDLPLGPQRKGPVCPALQFSLMGPKLYVCTTQVTVGRRPVTGLRLFLEGKKGNRLTIHLQHLSNLPKILQPHWDQHIAIGPPIWKEPEEQDSKWFEPVQWKSFSHVSTAPLEYLVESYVGEINSTYIVTGAQLRVWDFGIKNVLFLRLLFCRVPGCSIKRSFWDHTPQASQKSNLFSQLGLSSTSSARKAKPVPIVLNSAVYPDDPPTSTQTNKLLRFVDIKEMTKGAQDKPGHWLVTGAKLDVDGGKIALGVKYSLLHY

SEQ ID NO: 1143 - protein, 613 aa, Huperzia nummulariifolia (Blume)
MVWAGDQEMAQTDSDRMAAQATAREALQALGRGFDVTLDLRLAYCKGPSGSRIIEFDEEANLDLVIPGGAAIIPNVSRDIRCEKGERKHFRSDVLPFHQMAERFNDALNISGKVPSGFFNSVFSLNGTWQSDASAIKALAVDCWVISLYNMQISKTPQNLKEEVKKAVPPFWEPAALARFIEKYGTHIIMSVKIGGRDVVYIKQYQSSTLSPEEIKRYLREIADQRFAEGSGQGISNMQSKEKSSDPLTSANHAHRLQMANTHTSTSFTAKGDVEVILRRRGGDCMVKHHSDWLATVPFSPDVIAMSFIPITALLNGVPGSGFLSHAIKLYLRYKPPIEELQFFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEPVQWKSFSHVSTAPIEYGKEDDLIANIVTGAQLQVWDLGAKKVLFLRLLFSKVPGCSIKTSFWDHTPQSSQKSGLFSQLGLSTNFTSARKAKPAAVILNSAIFPEGPPAAVQKLKLLKFVDVKEMSKGAQDVPGHWLVTGAKLDVDKGKIALRVKYSLLHY

SEQ ID NO: 1144 - protein, 615 aa, Huperzia salvinioides
MVWAGDQEMAQTDSDRMAAQATAREALQALGRGFDVTLDLRLAYCKGPPGSCLIELDEEEKSDILIPGGAAIIPDVSRDIKCDKGERTHFSSEVLPFEQMSERFNQALSIPGKVPLGLFNTMFSLNGTWLSDASATKALAVDGWFISLYNMQISKIPLHLKEEVQKAVPPCWEPAALASFIEKYGTHIIMSVKIGGKDVVYIRQYQSSPLSPGEIKRYLKEIAGQRFAEGSEQVMLNMRSNEESPIPLTSHAHRLQMANAYTSASFTTKGDVEVILRRRGGDCMVKHHSDWLATVPFSPDVIAMSFIPITALLNGVPGSGFLSHAIKLYLRYKPPIEELQFFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGLLSQLGLSTTFSSASKAKPAPVVLNSAVFPEGPPVPVQNLKFLKFVDVKEMSKGAQDVPGHWLVTGAKLDVDKGKIALRLKYSLLHY

SEQ ID NO: 1145 - protein, 615 aa, Huperzia nummulariifolia (Blume)
MVWAGDQEMAQTDSDRMAAQATAREALQALGRGFDVTLDLRLAYCKGPPGSCLIELDEEEKSDILIPGGAAIIPDVSRDIKCDKGERTHFSSEVLPFEQMSERFNQALSIPGKVPLGLFNTMFSLNGTWLSDASATKALAVDGWFISLYNMQISKIPLHLKEEVQKAVPPCWEPAALASFIEKYGTHIIMSVKIGGKDVVYIRQYQSSPLSPGEIKRYLKEIAGQRFAEGSEQVMLNMRSNEESPIPLTSHAHRLQMANAYTSASFTTKGDVEVILRRRGGDCMVKHHSDWLATVPFSPDVIAMSFIPITALLNGVPGSGFLSHAIKLYLRYKPPIEELQFFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGLLSQLGLSTTFSSASKAKPAPVVLNSAVFPEGPPVPVQNLKFLKFVDVKEMMKGAQDMPGHWLVTGAKLDVDKGKIALRLKYSLLHY

SEQ ID NO: 1146 - protein, 627 aa, Huperzia phlegmoides
MVWAGDQEMAQTDSDRMAAQATAREALQALGRGFDVTLDLRLAYCKGPSGSHIIEFDEEANLDLVIPGGAAIIPNVSRDIRCEKGERKHFRSDVLPFHQMAERFNEALNIYGKVPLGLFNTMFSFNGTWQSDASATKALAVDCWVISLYNMQISKTPKNLKEEVKKAVPPFWEPAALARFIEKYGTHIIMSVKIGGKDVVYLRQYQSSTLSPEEIKRYLREIAASTLSPEEIKRYLREIADQRFAEGSGQGISNMQSKEKSSDPLTSTNHAHRLQMANTHTSASFTAKGDVEVIFRRRGGDCTVKHHSDWLATVPSSPDVVAMTFIPITSLLNEVPGSGLLSHAINLYLRYKPFLEFQIPRQWSPGFDLPIVPQRKEPVCPSLQFSLMGPKVYVSTNQVTVGRRPVTGLRLFLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGVFSQLGLSTTFSSASKAKPAPVVLNSAVFPEGPPVPVQNLKFLKFVDVKEMMKGAQDMPGHWLVTGAKLDVDKGKIALRVKYSLLHY

SEQ ID NO: 1147 - protein, 614 aa, Huperzia tetratoides
MVWAGDQEMVQKEPDRMVAQATAREALQALGRGFDVTLDLRLAYCKGPSGSHIIEFDEEVNLDLVIPGGATIIPNVSRDIKCEKGESTHFRSDVLPFHQMSERFNEALNISGEVPLGLFNTMFSLNGTWQSDASTTKALAIDGWFVSLYNMQISKTPQNLKEEVKKAVPPFWEPAALARFIEKYGTHIIMSVKIGGKDVVYIRQYQSSTLTPGEIKKYLKDIADQRFAEGSGQGISNMQSKEKSPDPLASTNHAHPLQMANTYTSASFTTKGDVEVIFRRRGGDCMVKHHSDWLATVPSSPDVIAMTFIPITSLLNEVPGSGFLSHAISLYLQYKPPIEELQFFLEFQISRQWSPGFDLPLVPQRKEPVCPSLQFSLMGPKLYVSTAQVTVGRRPVTGLRLCLEGKKGNRLAIHLQHLSNLPKILQPHWDQHIPIGLPVWKEPEEQDSKWFEPVQWKSFSHVSTAPIEYREESYVGETSAVYIVTGAQLRVWDFGLKNVLFLRLLFLKVPGCSVKRTVWDHSPESSQKSSLFPQLGLSTTFSSACKAKPAPVESNSTVFTEGDVKSLKFLKFVDIKEMTKGAQDMPGHWLVTGAKLDVDKGKIALRVKYSLLHY

SEQ ID NO: 1148 - protein, 403 aa, Huperzia nummulariifolia
MVWAGHQQMAQKEPGKFVAEVTAREAVQAIGRGFDVTLDLRLAYCKGPAGSRLIELDEEKNVDMVIPGGGFVLQGVSRDIRCDKGERTRFRSEVLSFHHMSERFNQALCISGKMPLGLFNSMYNLNGTWQSDASATKSLALDGWFISLYNLQLRKASLTLKEEVKEAVPSVWEPAALARFIDKYGTHIIESVKVGGKDVVYTRQYQSSPLTPGDIQKYLKELADQRFAEGSGQNNVNMRAKEKSLDPFAVTNHAHRLQLASTNTSSSFTAKGDVEVNYKRRGGDNLVRFHGDWLATVPLSPDVISMSFVPITSLLNGVPGSGFLSHAINLYLRYKPPIEELRSFLEFQIPRQWCPGFDLPLGPQRKEPACPSLQFSFMGPKLYINTAQVQFHFKLVKLSLSKI

SEQ ID NO: 1149 - protein, 613 aa, Huperzia squarrosa
MVWAGHRQMAQKEPGKLAAEVTAREAVQAIGRGFDVTLDLRLAYCKGPAGSRLIELDEEKNVDMVIPGGGFVLQGVSRDIRCDKGERTRFRSEVLSFHHMSERFNQALSISGKMPLGLFNTMYSLNGTWQSDASATKSLALDGWFISLYNLQLRKASLTLKEEVKEAVPSVWEPAALARFIDKYGTHIIESVKVGGKDVVYTRQYQSSPLTPGDIQKYLKELADQRFAEGSGQNNVNMRAKEKSPDPFTVTNHAHRLQLASTNTSSSFTAKGDVEVNFKRRGGDNLVRFHGDWLATVPLSPDVISMSFVPITSLLNGVPGSGFLSHAVNLYLRYKPPIEELRSFLEFQIPRQWSPGFDLPLGPQRKEPACPSLQFSFMGPKLYINTAQVIVGRRPVTGLQLFLEGKKGNRLAIHLQHLSNLPKILQPHWGQHISVGPPVWKQPEEQDTKWFEPVQWKSFSHVSTAPIEYGKEDDLIANIVTGAQFQVWDLGAKKVLFLRLLFSKVPGCSIKTSFWDHTPQSSQKSGLFSQLGLSTNFTSARKAKPAAVILNSAIFPEGPPSTVQKLKLLKFVDVKEMTKGAHDTPGHWLVTGARLDADRGKIALRVKYALLLY

SEQ ID NO: 1150 - protein, 356 aa, Huperzia carinata
MVWARDQEMAQTDSDRMAAQATAREALQALGRGFDVTLDLRLAYCKGPSGSHLIEFDEEANLDLVIPGGAAIIPNVSRDIRCEKGERKHFRSDVLPFHQMAERFNEALNISGKVPLGLFNTMFSFNGTWQSDASATKALAVDCWVISLYNMQISKTPKNLKEEVKKAVPPFWEPAALARFIEKYGTHIIMSVKIGGRDVVYIKQYQSSTLSPEEIKRYLREIADQRFAEGSGQGISNMQSKEKSSDPLTSTNHAHRLQMANTHTSASFTAKGDVEVIFRRRGGDCTVKHHSDWLATVPSSPDVVEMTFIPITSLLNEVPGSGFLSHAIKLYLRYKPPIEELQFFLEFQIPRVVSRF

SEQ ID NO: 1151 - protein, 482 aa, Huperzia carriata (Philippines)
MGIDWAGDQMAYREAERTIAQSTAIEALQCLGRGFDVTLDLRLAYCKGPSGSLLVELSEETYPEIVLPGGVVITNVSKDIKCDKGERTHFRSEVLTFHQMSTRFNEALSITGKMPLGLFNTMFSFNGTWQGDASETKALALDGWFITLYNMQITKPELSLNEEVKKAVPSSWEPAALARFIEKYGTHIIVSVKLGGKDVVYLKQYESSLLSSGEVQKYLKVIADQRFSEEAGQNISDTHLKDKLPDPLTSTNHAHRLQMASNFTSSSLTTIKDVEVIVRRRGGDSLVKRHNDWLATVSSAPDVVSMSFVAISSLLNGVPGSGFLSHAVNLYLRYKPPIEELQFFLEFQIPKQWSPGFDLPLGPQRKGPVCPAMQFSLMGPKLYVCTTQVTVGRRPVTGLRLFLEGKKGNRLTIHLQHLSNLPKILQPHWDQHIAIGPPIWKEPEEQDSKWFEPVQWKSFSHGARMLNKEILLGSHSTGFTEV

SEQ ID NO: 1152 - protein, 403 aa, Platycerium bifurcatum
MVWAGHQQMAQKEPGKFVAEVTAREAVQAIGRGFDVTLDLRLAYCKGPAGSRLIELDEEKNVDMVIPGGGFVLQGVSRDIRCDKGERTRFRSEVLSFHHMSERFNQALSIPGKVPLGLFNTMFSLNGTWQSDASATKSLALDGWFISLYNLQLRKASLTLKEEVKEAVPSVWEPAALARFIDKYGTHIIESVKVGGKDVVYTRQYQSSPLTPGDIQKYLKELADQRFAEGSGQNNVNMRAKEKSLDPFAVTNHAHRLQLASTNTSSSFTAKGDVEVNYKRRGGDNLVRFHGDWLATVPLSPDVISMSFVPITSLLNGVPGSGFLSHAINLYLRYKPPIEELRSFLEFQIPRQWCPGFDLPLGPQRKEPACPSLQFSFMGPKLYINTAQVQFHFKLVKLSLSKI

SEQ ID NO: 1153 - protein, 628 aa, Huperzia phlegmaria
MKERIYHYSSHMGIDWAGDQMAYREAERTIAQSTAIEALQCLGRGFDVTLDLRLAYCKGPSGSLLVELSEETYPEIVLPGGVVITNVSKDIKCDKGERTHFRSEVLTFHQMSTRFNEALSITGKMPLGLFNTMFSFNGTWQGDASETKALALDGWFITLYNMQITKPELSLNEEVKKAVPSSWEPAALARFIEKYGTHIIVSVKLGGKDVVYLKQYESSLLSSAEVQKYLKVTADQRFSEEAGLNISDTHLKDKLPDPLTSTNHAHRVPTASNFTSSSFTTIKDVEVILRRRGGDSLVKRHNDWLATVSSAPDVVSMSFVAISSLLNGVPGSGFLSHAVNLYLRYKPPIEELQFFLEFQIPKQWSPGFDLPLGPQRKGPVCPALQFSLMGPKLYVCTTQVTVGRRPVTGLRLFLEGKKGNRLTIHLQHLSNLPKILQPHWDQHIAIGPPIWKEPEEQDSKWFEPVQWKSFSHVSTAPIEYLKESYVGETSAVYIVTGAQLRVWDFGLKNVLFLRLLFLKVPGCSVKRTVWDHSPESSQKSGLFSQLGLSTTFSSASKAKPAPVVLNSAVFPEGPPVPVQNHKFLKFVDVKEMMKGAQDMPGHWLVTGAKLDVDKGKIALRVKYSLLHY

SEQ ID NO: 1154 - protein, 570 aa, Huperzia nummulariifolia (Blume)
MRERGIIEFDEEANLDLVIPGGAAIIPNVSRDIRCEKGERKHFRSDVLPFHQMAERFNDALNISGKVPSGFFNSVFSLNGTWQSDASAIKALAVDCWVISLYNMQISKTPQNLKEEVKKAVPPFWEPAALARFIEKYGTHIIMSVKIGGRDVVYIKQYQSSTLSPEEIKRYLREIADQRFAEGSGQGISNMQSKEKSSDPLTSANHAHRLQMANTHTSTSFTAKGDVEVIFRRRGGDCTVKHHSDWLDTVPSSPDVVEMTFIPITSLLNGVPGSGFLSHAIKLYLRYKPPIEELQFFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEHVQWKSFSHVSTAPIEYRRESYVGETSAVYIVTGAQLRVWDFGLKNVLFLRLLFLKVPGCSVKRSVWDHTPQASQKSGLFSQFGLSTNFTSAHKAKPAPVVLNSAVFPEGPPAPAQNLKLLKFVDVKEMSKGAQDVPGHWLVTGAKLDVDKGKIALRLKYSLLHY

SEQ ID NO: 1155 - protein, 588 aa, Huperzia nummarifolia
MVWAGDQEMAQTEPDRMAAQAIAREALQALGRGFDVTLDLRLAYCKGPSGSRIIEFDEKSNLDLVIPGGAAIIPNVSGDIRCEKGERKHFRSDVLPFHQMAERFNEALNISGKVPLGFFNTMFSLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKDVEVIFRRRGGDCTVKHHSDWLATVPSSPDVMAMTFIPITSLLNEVPGSGFLSHAINLYLRYKPPIEELQFFLEFQIPRQWSPGFDLPIVPQRKEPVCPSLQFSLMGPKIYVSTNQVTVGRRPVTGLRLFLEGKKGNRLAIHLQHLSSLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDRGKIALRVKYSLLHY

SEQ ID NO: 1156 - protein, 617 aa, Platycerium bifurcatum
MVWAGDQEMVQNEPDRMAAQATAREAMQALGRGFDVTLDLRLAYCKGPPGSCLIELDEEEKSDILIPGGAAIIPDVSRDIKCDKGERTHFSSEVLPFEQMSERFNQALSIPGKVPLGLFNTMFSLNGTWQSDASATKALAVEGWFISLYNMQISKIPLRLKEEVKKAVPPCWEPAALASFIEKYGTHIITSVKIGGKDVVYIRQYQSSPLSPGEIKSYLKEIADQRFAEGSEQFMLNMRSNEKSPIPLTSTSHAHRLQMANAYTSASFTTKGDVEVILRRRGGDCMVKHHSDWLATVPFSPDVIAMSFIPITALLNGVPGSGFLSHAINLYLRYKPPIEELQFFLEFQIPRLWSPGFDLPLVPQRKEPVCPSLQFSLMGPKIYVSTNQVTVGRRPVTGLRLFLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDKGKIALRVKYSLLHY

SEQ ID NO: 1157 - protein, 379 aa, Huperzia squarrosa
MTQTEPDRMVAQATAREALQALGRGFDVTLDHRLAYCKGSSGSHIIEFDEEVNLDLVIPGGAAIIPNVSRDIKCEKGERQHFRSNVLSFHQMSERFNEAINISGEVPSGLFNTMFSLNGTWQSDASATKALAVDGWFISLYTMQISKTPQNLKEEVKKAVPAFWEPAALARFIEKYGTHIITSVRIGGKDAVYIRQYQSSTLSPGEIKKYLKEIADQRFAEGSGQRISNMQSKEKSPDPLTSTNHAHRLQMANAYTSASFTTKGDVEVIFRRRGGDCMVKHHSDWLATVPSSPDVLAMTFIPITSLLNEVPGSGFLSHAINLYLRYKPPIEELRLFLEFQIPRQWSPGFDLFLDSGLQVSTCHLAVREKNLYILHCNSA

SEQ ID NO: 1158 - protein, 616 aa, Huperzia nummulariifolia (Blume)
MGIDWAGDQMAYREAERTIAQSTAIEALQCLGRGFDVTLDLRLAYCKGPSGSLLVELSEETYPEIVLPGGAVITNVSKDIKCDKGERTHFRSEVLTFHQMSTRFNEALSITGKMPLGLFNTMFSFNGTWQGDASETKALALDGWFITLYNMQITKPELSLNEEVKKAVPSSWEPAALARFIEKYGTHIIVSVKLGGKDVVYLKQYESSLLSSGEVQKYLKVTADQRFSEEAGQNIADTHLKDKLPDPLTSANHAHRLQTVGNITSSSFTTIKDVEVILRRRGGDSLVKRHNDWLATVSSAPDVVSMSFVAISSLLNGVPGSGFLSHAVNLYLRYKPPIEELQFFLEFQIPKQWSPGFDLPLGPQRKGPVCPALQFSLMGPKLYVCTTQVTVGRRPVTGLRLFLEGKKANRLTIHLQHLSNLPKILQPHWDQHIAIGPPIWKEPEEQDSKWFEPVQWKSFSHVSTAPLEYLVESYVGEINSTYIVTGAQLRVWDFGIKNVLFLRLLFCRVPGCSIKRSFWDHTPQTSQKSNLFSQLGLSSISSARKAKPVPIVLNSAVYPDDPPTSTQTNKLLKFVDIKEMTKGAQDKPGHWLVTGAKLDVDGGKIALGVKYSLLHY

SEQ ID NO: 1159 - protein, 617 aa, Huperzia nummulariifolia
MVWAGDQEMVQNEPDRMAAQAIAREALQALGRGFDVTLDLRLAYCKGPPGSCLIELDEEEKSDILIPGGAAIIPDVSRDIKCDKGERTHFSSEVLPFEQMSERFNQALCISGKMPLGLFNSMYNLNGTWQSDASATKALAVDCWVISLYNMQIFKTPKNLKEEVKKAVPPFWEPAALARFIEKYGTHIIMSVKIGGKDVVYIRQYQSSTLSPGEIKKYLKEIADQRFAEGSGHDISNMQSKEKSSDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRQWSPGFDLPLVPQRKEPVCPSLQFSLMGPKIYVSTNQVTVGRRPVTGLRLFLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDKGKIALRLKYSLLHY

SEQ ID NO: 1160 - protein, 617 aa, Huperzia salvinioides
MVWAGDQEMAQTDSDRMAAQATAREALQALGRGFDVTLDLRLAYCKGPSGSRIIEFDEEANLDLVIPGGAAIIPNVSRDIRCEKGERKHFRSDVLPFHQMAERFNEALNISGKVPLGLFNTMFSFNGTWQSDASAIKALAVDCWVISLYNMQISKTLKNLKEEVKKAVPPFWEPAALARFIEKYGTHIIMSVKIGGRDVVYIKQYQSSTLSPEEIKRYLREIADQRFAEGSGQGISNMQSKEKSSDPLTSANHAHRLQMANTHTSTSFTAKGDVEVILRRRGGDCMVKHHSDWLATVPFSPDVIAMSFIPITALLNGVPGSGFLSHAIKLYLRYKPPIEELQFFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEHVQWKSFSHVSTAPIEYRRESYVGETSAVYIVTGAQLRVWDFGLKNVLFLRLLFLKVPGCSVKRSVWDHTPQASQKSGLFSQFGLSTNFTSAHKAKPAPVVLNSAVFPEGPPAPAQNLKLLKFVDVKEMSKGAQDVPGHWLVTGAKLDVDKGKIALRLKYSLLHY

SEQ ID NO: 1161 - protein, 617 aa, Huperzia carriata (Philippines)
MVWAGDQEMVQNEPDRMNAQATAREAMQALGRGFDVTLDLRLAYCKGPPGSCLIELDEEEKSDILIPGGAAIIPDVSRDIKCDKGERTHFSSEVLPFEQMSERFNQALSIPGKVPLGLFNTMFSLNGTWQSDASTTKALAVDGWFISLYNMQISKIPLRLKEEVKKAVPPCWEPAALASFIEKYGTHIITSVKIGGKDVVYIRQYQSSPLSPGEIKRYLTEIADQRFAEGSEQFMSNMRSNEKSPIPLTSTSHAHRLQMANTYTSASFTTKGDVEVIFRRRGGDCTVKHHSDWLATVPSSPDVMSMTFIPITSLLNEVPGSGFLSHAINLYLRYKPPIEELQLFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEHVQWKSFSHVSTAPIEYRRESYVGETSAVYIVTGAQLRVWDFGLKNVLFLRLLFLKVPGCSVKRSVWDHTPQASQKSGLFSQFGLSTNFTSAHKAKPAPVVLNSAVFPEGPPAPAQNLKLLKFVDVKEMSKGAQDVPGHWLVTGAKLDVDKGKIALRLKYSLLHY

SEQ ID NO: 1162 - protein, 614 aa, Huperzia nummulariifolia (Blume)
MVWAGDQEMAQTDSDRMAAQATAREALQALGRGFDVTLDLRLAYCKGPPGSCLIELDEEEKSDILIPGGAAIIPDVSRDIKCDKGERTHFSSEVLPFEQMSERFNQALSIPGKVPLGLFNTMFSLNGTWLSDASATKALAVDGWFISLYNMQISKIPLHLKEEVQKAVPPCWEPAALASFIEKYGTHIIMSVKIGGKDVVYIRQYQSSPLSPGEIKRYLKEIAGQRFAEGSEQVMLNMRSNEESPIPLTSHAHRLQMANAYTSASFTTKGDVEVILRRRGGDCMVKHHSDWLATVPFSPDVIAMSFIPITALLNGVPGSGFLSHAIKLYLRYKPPIEELQFFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEPVQWKSFSHVSTAPLEYLVESYVGEINSTYIVTGAQLRVWDFGIKNVLFLRLLFCRVPGCSIKRSFWDHTPQTSQKSNLFSQLGLSSISSARKAKPVPIVLNSAVYPDDPPTSTQTNKLLKFVDIKEMTKGAQDKPGHWLVTGAKLDVDGGKIALGVKYSLLHY

SEQ ID NO: 1163 - protein, 382 aa, Huperzia squarrosa
MTQTEPDRMVAQATAREALQALGRGFDVTLDHRLAYCKGSSGSHIIEFDEEVNLDLVIPGGAAIIPNVSRDIKCEKGERQHFRSNVLSFHQMSERFNEAINISGEVPSGLFNTMFSLNGTWQSDASATKALAVDGWFISLYTMQISKTPQNLKEEVKKAVPAFWEPAALARFIEKYGTHIITSVRIGGKDAVYIRQYQSSTLSPGEIKKYLKEIADQRFAEGSGQRISNMQSKEKSPDPLTSTNHAHRLQMANAYTSASFTTKGDVEVIFRRRGGDCMVKHHSDWLATVPSSPDVLAMTFIPITSLLNEVPGSGFLSHAINLYLRYKPPIEELRLFLRTAVLLGISDSQAVVSRFRLAIWLSEKRTCISFIAIQLDGTKSLC

SEQ ID NO: 1164 - protein, 617 aa, Huperzia squarrosa
MVWAGHRQMAQKEPGKLAAEVTAREAVQAIGRGFDVTLDLRLAYCKGPPGSCLIELDEEEKSDILIPGGAAIIPDVSRDIKCDNGERTHFSSEVLPFEQMSERFNQALSISGKMPLGLFNTMYSLNGTWQSDASATKALAVDGWFISLYNMQISKTPQSLKEEVIKAVPPFWEPAALASFIEKYGTHIIMSVKIGGKDVVYIRQYQSSPLSPGEIKRYLKEIADQRFAEGSEQFMSNVRSNEKSPIPLTSTSHAHRLQMANAYTSASFTTKGDVEVILRRRGGDCMVKHHSDWLATVPFSPDVIAMSFIPITALLNGVPGSGFLSHAINLYLRYKPPIEELRLFLEFQIPRQWSPGFDLPFGCQRKEPVYPSLQFSLMGPKLYVSTAQVTVGRRPVTGLRLCLEGKKGNRLAIHLQHLSNLPKILQPHWDQHLPIGLPVWKEPEEQDSKWFEPVQWKSFSHVSTAPIEYRRESYVGETSAVYIVTGAQLRVWDFGLKNVLFLRLLFLKVPGCSVKRSIWDHAPQASQKSGLFSQFGLSTNFTSAHKAKPAPVVLNSAVFPEGPPAPAQNLKLLKFVDVKEMTKGAHDTPGHWLVTGARLDADRGKIALRVKYALLLY

SEQ ID NO: 1165 - protein, 613 aa, Huperzia nummarifolia
MVWAGHQQMAQKEPGKVVAEVTAREAVQAIGRGFDVTLDLRLAYCKGPAGSRLIELDEEKNVDMVIPGGGFVLQGVSRDIRCDKGERTRFRSEVLSFHHMSERFNQALCISGKMPLGLFNSMYNLNGTWQSDASATKSLALDGWFISLYNLQLRKASLTLKEEVKEAVPSVWEPAALARFIDKYGTHIIESVKVGGKDVVYTRQYQSSPLTPGDIQKYLKELADQRFAEGSGQNNVNMRAKEKSLDPFAVTNHAHRLQLASTNTSSSFTAKGDVEVNYKRRGGDNLVRFHGDWLATVPLSPDVISMSFVPITSLLNGVPGSGFLSHAINLYLRYKPPIEELRSFLEFQIPRQWCPGFDLPLGPQRKEPACPSLQFSFMGPKLYINTAQVIVGRRPVTGLQLFLEGKKGNRLAIHLQHLSNLPKILQPHWGQHIAVGPPVWKQPEELDTKWFEPVQWKSFSHVSTAPIEYGKEDDNIANIVTGAQLQVWDLGAKKVLFLRLLFSKVPGCSIKTSFWDHTPQSSQKSGLFSQLGLSTNFTSARKAKPAAVILNSAIFPEGPPAAVQKLKLLKFVDVKEMTKGAHDTPGHWLVTGARLDADRGKIALRVKYALLLY

SEQ ID NO: 1166 - protein, 420 aa, Platycerium bifurcatum
MVWAGDQEMAQTEPDRMAAQAIAREALQALGRGFDVTLDLRLAYCKGPSGSRIIEFDEKSNLDLVIPGGAAIIPNVSGDIRCEKGERTHFRSDVLPFHEMAERFNDALNISGKVPLGFFNTMFSLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKDVEVIFRRRGGDCTVKHHSDWLATVPSSPDVMAMTFIPITSLLNEVPGSGFLSHAINLYLRYKPPIEELQFFLEFQIPRQWSPGFDLPIVPQRKEPVCPSLQFSLMGPKIYVSTNQVTVGRRPVTGLRLFLEGKKGNRLAIHLQHLSNLPKILQPHWDQHIPIGLPVWKEPEEQDSK

SEQ ID NO: 1167 - protein, 651 aa, Huperzia nummarifolia
MVWAGDQEMVQNEPDRMAAQAIAREALQALGRGFDVTLDLRLAYCKGPSGSRIIEFDEKSNLDLVIPGGAAIIPNVSGDIRCEKGERKHFRSDVLPFHQMAERFNEALNISGKVPLGFFNTMFSLNGTWQSDASATKALAVDCWVISLYNMQIFKTPKNLKEEVKKAVPPFWEPADGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKSSDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRQWSPGFDLPIVPQRKEPVCPSLQFSLMGPKIYVSTNQVTVGRRPVTGLRLFLEGKKGNRLAIHLQHLSSLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDRGKIALRVKYSLLHY

SEQ ID NO: 1168 - protein, 507 aa, Huperzia goebelii (Holub)
MQISKTPKNLKEEVKKAVPPFWEPAALARFIEKYGTHIIMSVKIGGRDVVYIKQYQSSTLSPEEIKRYLREIADQRFAEGSGQGISNMQSKEKSSDLLTLSPEEIKRYLREIADQRFAEGSGQGISNMQSKEKSSDLLTSANHAHRLQMANTHTSTSFTAKGDVEVIFRRRGGDCTVKHHSDWLATVPSSPDVMSMTFIPITSLLNEVPGSGFLSHAINLYLRYKPPIEELQFFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGLFSQLGLSTTFSSASKAKPVPVVLNSAVFPEGPPVPVQNLKFLKFVDVKEMMKGAQDMPGHWLVTGAKLDVDKGKIALRVKYSLLHY

SEQ ID NO: 1169 - protein, 605 aa, Huperzia nummulariifolia
MVWAGDQEMAQTEPDRMAAQAIAREALQALGRGFDVTLDLRLAYCKGPSGSHIIEFDEEANLDLVIPGGAAIIPNVSGDIRCEKGERTHFRSDVLPFHEMAERFNDALNISGKVPLGFFNTMFSLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKSSDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRQWSPGFDLPLVPQRKEPVCPSLQFSLMGPKIYVSTNQVTVGRRPVTGLRLFLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDKGK

SEQ ID NO: 1170 - protein, 521 aa, Platycerium bifurcatum
MSERFNQALCISGKMPLGLFNSMYNLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGGSGHDISNMQSKEKSSDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRQWSPGFDLPIVPQRKEPVCPSLQFSLMGPKIYVSTNQVTVGRRPVTGLRLFLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGLFSQLGLSTTFSSASKARPAPVVLNSTVFPEGPPVPVQNLKFLKFVDVKEMMKGAQDMPGHWLVTGAKLDVDKGKIALRVKYSLLHY

SEQ ID NO: 1171 - protein, 617 aa, Huperzia squarrosa
MVWAGDQEMVQKEPDRMASQATAREALQALGRGFDVTLDLRLAYCKGPPGSCLIELDEEEKSDILIPGGAAIIPDVSRDIKCDNGERTHFSSEVLPFEQMSERFNQALSISGKMPLGLFNTMYSLNGTWQSDASATKALAVDGWFISLYNMQISKTPQSLKEEVIKAVPPFWEPAALASFIEKYGTHIIMSVKIGGKDVVYIRQYQSSPLSPGEIKRYLKEIADQRFAEGSEQFMSNVRSNEKSPIPLTSTSHAHRLQMANAYTSASFTTKGDVEVILRRRGGDCMVKHHSDWLATVPFSPDVIAMSFIPITALLNGVPGSGFLSHAINLYLRYKPPIEELRLFLEFQIPRQWSPGFDLPFGCQRKEPVYPSLQFSLMGPKLYVSTAQVTVGRRPVTGLRLCLEGKKGNRLAIHLQHLSNLPKILQPHWDQHLPIGLPVWKEPEEQDSKWFEPVQWKSFSHVSTAPIEYRRESYVGETSAVYIVTGAQLRVWDFGLKNVLFLRLLFLKVPGCSVKRSIWDHAPQASQKSGLFSQFGLSTNFTSAHKAKPAPVVLNSAVFPEGPPAPAQNLKLLKFVDVKEMSKGAQDVPGHWLVTGAKLDVDKGKIALRLKYSLLHY

SEQ ID NO: 1172 - protein, 388 aa, Huperzia salvinioides
MVWAGHQQMAQKEPGKLAAEVTAREAVQAIGRGFDVTLDLRLAYCKGPAGSRLIELDEEKNVDMVIPGGGFVLQGVSRDIRCDKGERTRFRSEVLSFHHMSERFNQALCISGKMPLGLFNAMYNLNGTWQSDASATKSLALDGWFISLYNLQLRKASLTLKEEVKEAVPSVWEPAALARFIDRYGTHIIESVKVGGKDVVYTRQYQSSPLTPGDIQKYLKELADQRFAEGSGQNNVNMRAKEKSLDPFTVTNHAHRLQLASTNTSSSFTAKGDVEVNYKRRGGDNLVRFHGDWLATVPLSPDVVSMSFVPITSLLNGVPGSGFLSHAINLYLRYKPPIEELRSFLEFQIPRQWCPGFDLPLGPQRKEPVCPSLQFSFMGPKLYINTAQ

SEQ ID NO: 1173 - protein, 497 aa, Huperzia tetratoides
MGMVWAGDQMAYREAERTIAQSTAIEALQCLGRGFDVTLDLRLAYCKGPSGSRLVELSEETYPEIVLPGGVVIPNVSKDIKCDKGERTHFRSEVLTFHQMSTRFNEALSITGKMPLGLFNTMFSFNGTWQGDASETKALALDGWFITLYNMQITKPELSLNEEVKKAVPSSWEPAALARFIEKYGTHIIVSVKLGGKDVVYLKQFESSLLSSGEVQKYLKVIADQRFSEEAGQNISDTRLKDKSPDPLTSTNHAQRLQMASNVTSSSFSPIKDVEVILRRRGGDSLVKHHNDWLATVSSAPDVVSMSFVAISSLLNGVPGSGFLSHAVNLYLRYKPPIEELQFFLEFQIPKQWSPGFDLPLGPQRKGPVCPAMQFSLMGPKLYVCTTQVTVGRRPVTGLRLFLEGKKGNRLTIHLQHLSNLPKILQPHWDQHIAIGPPIWKEPEEQDSKWFEPVQWKSFSHVSTAPLEYLVESYVGEINATYIVTGAQLRVWDFGIK

SEQ ID NO: 1174 - protein, 348 aa, Huperzia carinata
MVWARDQEMAQTDSDRMAAQATAREALQALGRGFDVTLDLRLAYCKGPPGSCLIELDEEEKSDILIPGGAAIIPDVSRDIKCDKGERTHFSSEVLPFEQMSERFNQALSIPGKVPLGLFNTMFSLNGTWQSDASATKALAVDGWFISLYNMQISKIPLRLKEEVKKAVPPCWEPAALASFIEKYGTHIITSVKIGGKDVVYIRQYQSSPLSPGEIKRYLTEIADQRFAEGSEQFMLNMRSNEKSPIPLTSTSHAHRLQMANTYTSASFTTKGDVEVIFRRRGGDCTVKHHSDWLATVPSSPDVVEMTFIPITSLLNEVPGSGFLSHAIKLYLRYKPPIEELWIFVSCY

SEQ ID NO: 1175 - protein, 345 aa, Huperzia carinata
MVWARDQEMAQTDSDRMAAQATAREALQALGRGFDVTLDLRLAYCKGPSGSHLIEFDEEANLDLVIPGGAAIIPNVSRDIRCEKGERKHFRSDVLPFHQMAERFNEALNISGKVPLGLFNTMFSFNGTWQSDASATKALAVDCWVISLYNMQISKTPKNLKEEVKKAVPPFWEPAALARFIEKYGTHIIMSVKIGGRDVVYIKQYQSSTLSPEEIKRYLREIADQRFAEGSGQGISNMQSKEKSSDPLTSTNHAHRLQMANTHTSASFTAKGDVEVIFRRRGGDCTVKHHSDWLATVPSSPDVVEMTFIPITSLLNEVPGNKPPIEELQFFLEFQIPRVWSPGFD

SEQ ID NO: 1176 - protein, 617 aa, Huperzia nummarifolia
MVWAGDQEMVQNEPDRMAAQAIAREALQALGRGFDVTLDLRLAYCKGPSGSRIIEFDEKSNLDLVIPGGAAIIPNVSGDIRCEKGERKHFRSDVLPFHQMAERFNEALNISGKVPLGFFNTMFSLNGTWQSDASATKALAVEGWFISLYNMQISKIPLRLKEEVKKAVPPCWEPAALASFIEKYGTHIITSVKIGGKDVVYIRQYQSSPLSPGEIKRYLKEIADQRFAEGSEQFMLNMRSNEKSPIPLTSTSHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRQWSPGFDLPIVPQRKEPVCPSLQFSLMGPKIYVSTNQVTVGRRPVTGLRLFLEGKKGNRLAIHLQHLSSLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDRGKIALRVKYSLLHY

SEQ ID NO: 1177 - protein, 496 aa, Platycerium bifurcatum
MFSLNGTWQSDASATKALAVEGWFISLYNMQISKIPLRLKEEVKKAVPPCWEPAALASFIEKYGTHIITSVKIGGKDVVYIRQYQSSPLSPGEIKSYLKEIADQRFAEGSEQFMLNMRSNEKSPIPLTSTSHAHRLQMANAYTSASFTTKGDVEVILRRRGGDCMVKHHSDWLATVPFSPDVIAMSFIPITALLNGVPGSGFLSHAINLYLRYKPPIEELQFFLEFQIPRQWSPGFDLPIVPQRKEPVCPSLQFSLMGPKIYVSTNQVTVGRRPVTGLRLFLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGLFSQLGLSTTFSSASKARPAPVVLNSTVFPEGPPVPVQNLKFLKFVDVKEMMKGAQDMPGHWLVTGAKLDVDKGKIALRLKYSLLHY

SEQ ID NO: 1178 - protein, 569 aa, Huperzia nummulariifolia (Blume)
MRERGIIEFDEEANLDLVIPGGAAIIPNVSRDIRCEKGERKHFRSDVLPFHQMAERFNDALNISGKVPSGFFNSVFSLNGTWQSDASAIKALAVDCWVISLYNMQISKTPQNLKEEVKKAVPPFWEPAALARFIEKYGTHIIMSVKIGGRDVVYIKQYQSSTLSPEEIKRYLREIADQRFAEGSGQGISNMQSKEKSSDPLTSANHAHRLQMANTHTSTSFTAKGDVEVIFRRRGGDCTVKHHSDWLDTVPSSPDVVEMTFIPITSLLNGVPGSGFLSHAIKLYLRYKPPIEELQFFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEPVQWKSFSHVSTAPLEYLVESYVGEINSTYIVTGAQLRVWDFGIKNVLFLRLLFCRVPGCSIKRSFWDHTPQTSQKSNLFSQLGLSSISSARKAKPVPIVLNSAVYPDDPPTSTQTNKLLKFVDIKEMTKGAQDKPGHWLVTGAKLDVDGGKIALGVKYSLLHY

SEQ ID NO: 1179 - protein, 367 aa, Huperzia nummulariifolia (Blume)
MVWAGHQQMAQKEPGKLAAEVTAREAVQAIGRGFDVTLDLRLAYCKGPSGSRIIEFDEEANLDLVIPGGAAIIPNVSRDIRCEKGERKHFRSDVLPFHQVPGGAAIIPNVSRDIRCEKGERKHFRSDVLPFHQMAERFNDALNISGKVPSGFFNSVFSLNGTWQSDASAIKALAVDCWVISLYNMQISKTPQNLKEEVKKAVPPFWEPAALARFIEKYGTHIIMSVKIGGRDVVYIKQYQSSTLSPEEIKRYLREIADQRFAEGSGQGISNMQSKEKSSDPLTSANHAHRLQMANTHTSTSFTAKGDVEVILRRRGGDCMVKHHSDWLATVPFSPDVIAMSFIPITALLNGVPGSGFLSHAIKLYLR

SEQ ID NO: 1180 - protein, 617 aa, Platycerium bifurcatum
MVWAGDQEMAQTEPDRMAAQAIAREALQALGRGFDVTLDLRLAYCKGPSGSRIIEFDEKSNLDLVIPGGAAIIPNVSGDIRCEKGERKHFRSDVLPFHEMAERFNDALNISGKVPLGFFNTMFSLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKSSDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRLWSPGFDLPLVPQRKEPVCPSLQFSLMGPKIYVSTNQVTVGRRPVTGLRLFLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDKGKIALRVKYSLLHY

SEQ ID NO: 1181 - protein, 609 aa, Huperzia squarrosa
MTQTEPDRMVAQATAREALQALGRGFDVTLDLRLAYCKGPPGSCLIELDEEEKSDILIPGGAAIIPDVSRDIKCDNGERTHFSSEVLPFEQMSERFNQALSISGKMPLGLFNTMYSLNGTWQSDASATKALAVDGWFISLYNMQISKTPQSLKEEVIKAVPPFWEPAALASFIEKYGTHIIMSVKIGGKDVVYIRQYQSSPLSPGEIKRYLKEIADQRFAEGSEQFMSNVRSNEKSPIPLTSTSHAHRLQMANAYTSASFTTKGDVEVILRRRGGDCMVKHHSDWLATVPFSPDVIAMSFIPITALLNGVPGSGFLSHAINLYLRYKPPIEELRLFLEFQIPRQWSPGFDLPFGCQRKEPVYPSLQFSLMGPKLYVSTAQVTVGRRPVTGLRLCLEGKKGNRLAIHLQHLSNLPKILQPHWDQHLPIGLPVWKEPEEQDSKWFEPVQWKSFSHVSTAPIEYRRESYVGETSAVYIVTGAQLRVWDFGLKNVLFLRLLFLKVPGCSVKRSIWDHAPQASQKSGLFSQFGLSTNFTSAHKAKPAPVVLNSAVFPEGPPAPAQNLKLLKFVDVKEMSKGAQDVPGHWLVTGAKLDVDKGKIALRVKYSLLHY

SEQ ID NO: 1182 - protein, 628 aa, Platycerium bifurcatum
MVWAGDQEMAQTEPDRMAAQAIAREALQALGRGFDVTLDLRLAYCKGPSGSRIIEFDEKSNLDLVIPGGAAIIPNVSGDIRCEKGERTHFRSDVLPFHEMAERFNDALNISGKVPLGFFNTMFSLNGTFSLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGAEGSGHDISNMQSKEKSSDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRQWSPGFDLPIVPQRKEPVCPSLQFSLMGPKIYVSTNQVTVGRRPVTGLRLFLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKIPGCSVKRSVWDHTPQASQKSGLFSQFGLSTNFTSAHKAKPAPVVLNSAVFPEGPPAPAQNLKLLKFVDVKEMSKGAQDVPGHWLVTGAKLDVDKGKIALRLKYSLLHY

SEQ ID NO: 1183 - protein, 517 aa, Huperzia phlegmaria
MAERFNEALSISGKVPLGLFNTVFSLNGTWQSDASAIKALAVDCWVISLYNMQISRTPKNLKEEVKKAVPPFWEPAALARFIEKYGTHIIMSVKIGGKDVVYLRQYQSSTLSPGEIKKYLKEIADQRFAEGSGHDISNMQSKEKSSDPLTSTNHAHRLQMANAHTSASFTAKGDVEVIFRRRGGDCTVKHHSDWLDTVPSSPDVVEMTFIPITSLLNEVPGSGFLSHAIKLYLRYKPPIEELQFFLEFQIPRQWSPGFDLPIVPQRKEPVCPSLQFSLMGPKVYVSTNQVTVGRRPVTGLRLFLEGKKGNRLAIHLQHLSNLPKILQLHWDQHIPIGLPVWKEPEEQDSKWFEPVQWKSFSHVSTAPLEYLVESYVGEINSTYIVTGAQLRVWDFGIKNVLFLRLLFCRVPGCSIKRSFWDHTPQASQKSNLFSQLGLSSTSSARKAKPVPIVLNSAVYPDDPPTSTQTNKLLKFVDNKEMTKGAQDKPGHWLVTGAKLDVDGGKIALGVKYSLLHY

SEQ ID NO: 1184 - protein, 482 aa, Huperzia phlegmoides
MGIDWAGDQMAYREAERTIAQSTAIEALQCLGRGFDVTLDLRLAYCKGPSGSLLVELSEETYPEIVLPGGAVITNVSKDIKCDKGERTHFRSEVLTFHQMSTRFNEALSITGKMPLGLFNTMFSFNGTWQGDASETKALALDGWFITLYNMQITKPELSLNEEVKKAVPSSWEPAALARFIEKYGTHIIVSVKLGGKDVVYLKQYESSLLSSGEVQKYLKVIADQRFSEEAGQNISDTHLKDKLPDPLTSTNHAHRLQMASNFTSSSFTTIKDVEVIVRRRGGDSLVKRHNDWLATVSSAPDVVSMSFVAISSLLNGVPGSGFLSHAVNLYLRYKPPIEELQFFLEFQIPKQWSPGFDLPLGPQRKGPVCPVMQFSLMGPKLYVCTTQVTVGRRPVTGLRLFLEGKKGNRLTIHLQHLSNLPKILQPHWDQHIAIGPPIWKEPEEQDSKWFEPVQWKSFSHGARMLNKEILLGSHSTGFTEV

SEQ ID NO: 1185 - protein, 620 aa, Platycerium bifurcatum
MVWAGDQEMAQTEPDRMAAQAIAREALQALGRGFDVTLDLRLAYCKGPSGSRIIEFDEKSNLDLVIPGGAAIIPNVSGDIRCEKGERTHFRSDVLPFHEMAERFNDALNISGKVPLGFFNTMFSLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGGSGHDISNMQSKEKSSDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRQWSPGFDLPIVPQRKEPVCPSLQFSLMGPKIYVSTNQVTVGRRPVTGLRLFLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKIPGCSVKRSVWDHTPQASQKSGLFSQFGLSTNFTSAHKAKPAPVVLNSAVFPEGPPAPAQNLKLLKFVDVKEMSKGAQDVPGHWLVTGAKLDVDKGKIALRLKYSLLHY

SEQ ID NO: 1186 - protein, 409 aa, Huperzia phlegmoides
MVWAGDQEMAQTDSDRMAAQATAREALQALGRGFDVTLDLRLAYCKGPSGSHIIEFDEEANLDLVIPGGAAIIPNVSRDIRCEKGERKHFRSDVLPFHQMAERFNEALNIYGKVPLGLFNTMFSFNGTWQSDASATKALAVDCWVISLYNMQISKTPKNLKEEVKKAVPPFWEPAALARFIEKYGTHIIMSVKIGGKDVVYLRQYQSSTLSPEEIKRYLREIADQRFAEGSGHDISNMQSKDQSSTLSPEEIKRYLREIADQRFAEGSGQGISNMQSKEKSSDPLTSTNHAHRLQMANTHTSASFTAKGDVEVIFRRRGGDCTVKHHSDWLATVPSSPDVVAMTFIPITSLLNEVPGSGLLSHAINLYLRYKPCSSSWNFRFLDSGLQVLTCQLSPREKNLYVLHCNSA

SEQ ID NO: 1187 - protein, 356 aa, Huperzia carinata
MVWARDQEMAQTDSDRMAAQATAREALQALGRGFDVTLDLRLAYCKGPSGSHLIEFDEEANLDLVIPGGAAIIPNVSRDIRCEKGERKHFRSDVLPFHQMAERFNEALNISGKVPLGLFNTMFSFNGTWQSDASATKALAVDCWVISLYNMQISKTPKNLKEEVKKAVPPFWEPAALARFIEKYGTHIIMSVKIGGRDVVYIKQYQSSTLSPEEIKRYLREIADQRFAEGSGQGISNMQSKEKSSDPVTSANHAHRLQMANTHTSTSFKAKGDVEVIFRRKGGDCTVKHHSDWLATVPSSPDVVEMTFIPITSLLNEVPGSGFLSHAIKLYLRYKPPIEELQFFLEFQIPRVVSRF

SEQ ID NO: 1188 - protein, 384 aa, Platycerium bifurcatum
MVWAGDQEMVQNEPDRMAAQATAREAMQALGRGFDVTLDLRLAYCKGPPGSCLIELDEEEKSDILIPGGAAIIPDVSRDIKCDKGERTHFSSEVLPFEQMSERFNQALSIPGKVPLGLFNTMFSLNGTWQSDASATKALAVEGWFISLYNMQISKIPLRLKEEVKKAVPPCWEPAALASFIEKYGTHIITSVKIGGKDVVYIRQYQSSPLSPGEIKSYLKEIADQRFAEGSEQFMLNMRSNEKSPIPLTSTSHAHRLQMANAYTSASFTTKGDVEVILRRRGGDCMVKHHSDWLATVPFSPDVIAMSFIPITALLNGVPGSGFLSHAINLYLRYKPPIEELQFFLEFQIPRLWSPGFDLPLVPQRKEPVCPSLQFSLMGVVSRF

SEQ ID NO: 1189 - protein, 597 aa, Huperzia carriata (Philippines)
MGIDWAGDQMAYREAERTIAQSTAIEALQCLGRGFDVTLDLRLAYCKGPSGSLLVELSEETYPEIVLPGGVVITNVSKDIKCDKGERTHFRSEVLTFHQMSTRFNEALSITGKMPLGLFNTMFSFNGTWQGDASETKALALDGWFITLYNMQITKPELSLNEEVKKAVPSSWEPAALARFIEKYGTHIIVSVKLGGKDVVYLKQYESSLLSSGEVQKYLKVIADQRFSEEAGQNISDTHLKDKLPDPLTSTNHAHRLQMASNFTSSSLTTIKDVEVIVRRRGGDSLVKRHNDWLATVSSAPDVVSMSFVAISSLLNGVPGSGFLSHAVNLYLRYKPPIEELQFFLEFQIPKQWSPGFDLPLGPQRKGPVCPAMQFSLMGPKLYVCTTQVTVGRRPVTGLRLFLEGKKGNRLTIHLQHLSNLPKILQPHWDQHIAIGPPIWKEPEEQDSKWFEPVQWKSFSHVSTAPIEYLQESYIGETSAVYIVTGAQLRVWDFGLKNVLFLRLLFLKVPGCSVKRTVWDHSPESSQKSGLFSQLAVSKTFSSAHKAKPAPVVLNSAVLPEGPHVPVQSLKFLKFVDVKEMIKGAITTIVFSVLFLL

SEQ ID NO: 1190 - protein, 608 aa, Huperzia carriata (Philippines)
MAQTDSDRMAAQATAREALQALGRGFDVTLDLRLAYCKGPSGSRIIEFDEEANLDLVVPGGAAIIPNVSGDIRCEKGERTHFISDVLPFHQMAERFNDALNISGKVPLGFFNTVFSLNGTWQSDASTTKALAVDGWFMSLYNMQISKTPQNLKEEVKKAVPPFWEPAALARFIEKYGTHIIMSVKIGGKDVVYLRQYQSSTLSPGEIKKYLKEIADQRFAEGSGQGISNMQSKEKSSDPVTSANHAHRLQMANTHTSTSFKAKGDVEVIFRRKGGDCTVKHHSDWLATVPSSPDVMSMTFIPITSLLNEVPGSGFLSHAINLYLRYKPPIEELQLFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEPVQWKSFSHVSTAPLEYLVESYVGEINSTYIVTGAQLRVWDFGIKNVLFLRLLFCRVPGCSIKRSFWDHTPQASQKSNLFSQLGLSSISSARKAKPVPIVLNSAVFPDDPPQSTQTHKLLKFVDIKEMTKGAQDKPGHWLVTGAKLDVDGGKIALGVKYSLLHY

SEQ ID NO: 1191 - protein, 617 aa, Huperzia nummulariifolia
MVCAGDQEMAQTEPDRMAAQAIAREALQALGRGFDVTLDLRLAYCKGPSGSHIIEFDEEANLDLVIPGGAAIIPNVSGDIRCEKGERTHFRSDVLPFHEMAERFNDALNISGKVPLGFFNTMFSLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKSSDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRQWSPGFDLPLVPQRKEPVCPSLQFSLMGPKIYVSTNQVTVGRRPVTGLRLFLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDKGKIALRVKYSLLHY

SEQ ID NO: 1192 - protein, 588 aa, Huperzia nummulariifolia
MVWAGDQEMAQTEPDRMAAQAIAREALQALGRGFDVTLDLRLAYCKGPSGSHIIEFDEEANLDLVIPGGAAIIPNVSGDIRCEKGERTHFRSDVLPFHEMAERFNDALNISGKVPLGFFNTMFSLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKDVEVIFRRRGGDCTVKHHSDWLATVPSSPDVMAMTFIPITSLLNEVPGSGFLSHAINLYLRYKPPIEELQFFLEFQIPRQWSPGFDLPLVPQRKEPVCPSLQFSLMGPKIYVSTNQVTVGRRPVTGLRLFLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDKGKIALRVKYSLLHY

SEQ ID NO: 1193 - protein, 609 aa, Huperzia squarrosa
MTQTEPDRMVAQATAREALQALGRGFDVTLDLRLAYCKGPPGSCLIELDEEEKSDILIPGGAAIIPDVSRDIKCDNGERTHFSSEVLPFEQMSERFNQALSISGKMPLGLFNTMYSLNGTWQSDASATKALAVDGWFISLYNMQISKTPQSLKEEVIKAVPPFWEPAALASFIEKYGTHIIMSVKIGGKDVVYIRQYQSSPLSPGEIKRYLKEIADQRFAEGSEQFMSNVRSNEKSPIPLTSTSHAHRLQMANAYTSASFTTKGDVEVILRRRGGDCMVKHHSDWLATVPFSPDVIAMSFIPITALLNGVPGSGFLSHAINLYLRYKPPIEELRLFLEFQIPRQWSPGFDLPFGCQRKEPVYPSLQFSLMGPKLYVSTAQVTVGRRPVTGLRLCLEGKKGNRLAIHLQHLSNLPKILQPHWDQHLPIGLPVWKEPEEQDSKWFEPVQWKSFSHVSTAPIEYRRESYVGETSAVYIVTGAQLRVWDFGLKNVLFLRLLFLKVPGCSVKRSIWDHAPQASQKSGLFSQFGLSTNFTSAHKAKPAPVVLNSAVFPEGPPAPAQNLKLLKFVDVKEMTKGAHDTPGHWLVTGARLDADRGKIALRVKYALLLY

SEQ ID NO: 1194 - protein, 449 aa, Platycerium bifurcatum
MVWAGDQEMVQNEPDRMAAQAIAREALQALGRGFDVTLDLRLAYCKGPSGSRIIEFDEKSNLDLVIPGGAAIIPNVSGDIRCEKGERTHFRSDVLPFHEMAERFNDALNISGKVPLGFFNTMFSLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKSSDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRQWSPGFDLPIVPQRKEPVCPSLQFSLMGPKIYVSTNQVTVGRRPVTGLRLFLEGKKGNRLAIHLQHLSNLPKILQPHWDQHIPIGLPVWKEPEEQDSK

SEQ ID NO: 1195 - protein, 617 aa, Huperzia nummarifolia
MVWAGDQEMAQTEPDRMAAQAIAREALQALGRGFDVTLDLRLAYCKGPSGSRIIEFDEKSNLDLVIPGGAAIIPNVSGDIRCEKGERKHFRSDVLPFHQMAERFNEALNISGKVPLGFFNTMFSLNGTWQSDASATKALAVEGWFISLYNMQISKIPLRLKEEVKKAVPPCWEPAALASFIEKYGTHIITSVKIGGKDVVYIRQYQSSPLSPGEIKRYLKEIADQRFAEGSEQFMLNMRSNEKSPIPLTSTSHAHRLQMANAYTSASFTTKGDVEVILRRRGGDCMVKHHSDWLATVPFSPDVIAMSFIPITALLNGVPGSGFLSHAINLYLRYKPPIEELQFFLEFQIPRQWSPGFDLPIVPQRKEPVCPSLQFSLMGPKIYVSTNQVTVGRRPVTGLRLFLEGKKGNRLAIHLQHLSSLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDRGKIALRVKYSLLHY

SEQ ID NO: 1196 - protein, 617 aa, Platycerium bifurcatum
MVWAGDQEMVQNEPDRMAAQATAREAMQALGRGFDVTLDLRLAYCKGPPGSCLIELDEEEKSDILIPGGAAIIPDVSRDIKCDKGERTHFSSEVLPFEQMSERFNQALSIPGKVPLGLFNTMFSLNGTWQSDASATKALAVEGWFISLYNMQISKIPLRLKEEVKKAVPPCWEPAALASFIEKYGTHIITSVKIGGKDVVYIRQYQSSPLSPGEIKSYLKEIADQRFAEGSEQFMLNMRSNEKSPIPLTSTSHAHRLQMANAYTSASFTTKGDVEVILRRRGGDCMVKHHSDWLATVPFSPDVIAMSFIPITALLNGVPGSGFLSHAINLYLRYKPPIEELQFFLEFQIPRLWSPGFDLPLVPQRKEPVCPSLQFSLMGPKIYVSTNQVTVGRRPVTGLRLFLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKIPGCSVKRSVWDHTPQASQKSGLFSQFGLSTNFTSAHKAKPAPVVLNSAVFPEGPPAPAQNLKLLKFVDVKEMSKGAQDVPGHWLVTGAKLDVDKGKIALRLKYSLLHY

SEQ ID NO: 1197 - protein, 620 aa, Huperzia carriata (Solomon Islands)
MVWAGDQEMAQIEPDRMAAQATAREALQALGRGFDVTLDLRLAYCKGPSGSRIIEFDEEANLDLVIPGGAAIIPNVSGDIRCEKGERTHFISDVLPFHQMAERFNDALNISGKVPLGFFNTVFSLNGTWQSDASTTKALAVDGWFMSLYNMQISKTPKNLKEEVKKAVPPFWEPAALARFIEKYGTHIIMSVKIGGKDAVYLRQYQSSTLSPGEIKKYLKEIADQRFAEGSGQGISNMQSKEKSSDPLTSTNHAHRLQMANTHTSASFTAKGDVEVIFRRRGGDCTVKHHSDWLATVPSSPDVMSMTFIPITSLLNDVPGSGFLSHAINLYLRYKPPIEELQFFLEFQIPRQWSPGFDLPIVPQRKEPVCPSLQFSLMGPKVYVSTNQVTVGRRPVTGLRLFLEGKKGNRLAIHLQHLSNLPKILQPHWDQHLPIGLPVWKEPEEQDSKWFEHVQWKSFSHVSTAPIEYRRESYVGETSAVYIVTGAQLRVWDFGLKNVLFLRLLFLKVPGCSVKRSVWDHTPQASQKSGLFSQFGLSTNFTSAHKAKPAPVVLNSAVFPEGPPAPAQNLKLLKFVDVKEMSKGAQDVPGLPGHWLVTGAKLDVDKGKIALRLKYSLLHY

SEQ ID NO: 1198 - protein, 507 aa, Huperzia goebelii (Holub)
MQISKTPKNLKEEVKKAVPPFWEPAALARFIEKYGTHIIMSVKIGGRDVVYIKQYQSSTLSPEEIKRYLREIADQRFAEGSGQGISNMQSKEKSSDLLTLSPEEIKRYLREIADQRFAEGSGQGISNMQSKEKSSDLLTSANHAHRLQMANTHTSTSFTAKGDVEVIFRRRGGDCTVKHHSDWLATVPSSPDVMSMTFIPITSLLNEVPGSGFLSHAINLYLRYKPPIEELQFFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRSVWDHTPQASQKSGLFSQFGLSTNFTSAHKAKPAPVVLNSAVFPEGPPAPAQNLKLLKFVDVKEMLKGAQDVPGHWLVTGAKLDVDRGKIALRLKYSLLHY

SEQ ID NO: 1199 - protein, 400 aa, Huperzia phlegmoides
MVWAGDQEMAQTDSDRMAAQATAREALQALGRGFDVTLDLRLAYCKGPSGSHIIEFDEEANLDLVIPGGAAIIPNVSRDIRCEKGERKHFRSDVLPFHQMAERFNEALNIYGKVPLGLFNTMFSFNGTWQSDASATKALAVDCWVISLYNMQISKTPKNLKEEVKKAVPPFWEPAALARFIEKYGTHIIMSVKIGGKDVVYLRQYQSSTLSPEEIKRYLREIADQRFAEGSGHDISNMQSKDQSSTLSPEEIKRYLREIADQRFAEGSGQGISNMQSKEKSSDPLTFANTHTSTSFKAKGDVEVIFRRRGGDCTVKHHSDWLATVPSSPDVVAMTFIPITSLLNEVPGSGLLSHAINLYLRYKPCSSSWNFRFLDSGLQVLTCQLSPREKNLYVLHCNSA

SEQ ID NO: 1200 - protein, 508 aa, Huperzia tetratoides
MVSAGHRQMAQKEPGKLAAEVTAREAVQAIGRGFDVTLDLRLAYCKGPAGSRLIELDEEKNVDMVIPGGGFVLRGVSRDIRCDKGERTRFRSEVLSFHHMSERFNQALSISGKMPLGLFNTMYSLNGTWQSDASATKSLALDGWFISLYNLQLRKASLTLKEEVKEAVPSVWEPAALARFIDKYGTHIIESVKVGGKDVVYTRQYQSSPLTSGDIQKYLKELADQRFAEGSGTNNVNMRAKEKSPDPFTVTNHAHRLQLASTNTSSSFTAKGDVEVNFKRRGGDNLVRFHGDWLATVPLSPDVISMSFVPITSLLNGVPGSGFLSHAVNLYLRYKPPIEELRSFLEFQIPRQWSPGFDLPLGPQRKEPACPSLQFSFMGPKLYINTAQVIVGRRPVTGLQLFLEGKKGNRLAIHLQHLSNLPKILQPHWGQHISVGPPVWKQPEEQDTKWFEPVQWKSFSHYNICRIFLRSFNLIGANIYLLGRLYGSSPKSKIPNGLNRFNGKASLM

SEQ ID NO: 1201 - protein, 571 aa, Huperzia tetratoides
MVSAGHRQMAQKEPGKLAAEVTAREAVQAIGRGFDVTLDLRLAYCKGPAGSRLIELDEEKNVDMVIPGGGFVLRGVSRDIRCDKGERTRFRSEVLSFHHMSERFNQALSISGKMPLGLFNTMYSLNGTWQSDASATKSLALDGWFISLYNLQLRKASLTLKEEVKEAVPSVWEPAALARFIDKYGTHIIESVKVGGKDVVYTRQYQSSPLTSGDIQKYLKELADQRFAEGSGTNNVNMRAKEKSPDPFTVTNHAHRLQLASTNTSSSFTAKGDVEVNFKRRGGDNLVRFHGDWLATVPLSPDVISMSFVPITSLLNGVPGSGFLSHAVNLYLRYKPPIEELRSFLEFQIPRQWSPGFDLPLGPQRKEPACPSLQFSFMGPKLYINTAQVIVGRRPVTGLQLFLEGKKGNRLAIHLQHLSNLPKILQPHWGQHISVGPPVWKQPEEQDTKWFEPVQWKSFSHVSTAPIEYGKEDDLIANIVTGAQLQVWELGAKKVLFLRLLFSKVPGCSIKTSFWDHTPQSSQKSGLFSQLGLSTNFTSARKAKPAAVILNSAIFPEGPPAACEGDDQGCS

SEQ ID NO: 1202 - protein, 617 aa, Huperzia nummarifolia
MGIDWAGDQMAYREAERTIAQSTAIEALQCLGRGFDVTLDLRLAYCKGPSGSLLVELSEETYPEIVLPGGVVITNVSKDIKCDKGERTHFRSEVLTFHQMSTRFNEALSITGKMPLGLFNTMFSFNGTWQGDASETKALALDGWFITLYNMQITKPELSLNEEVKKAVPSSWEPAALARFIEKYGTHIIVSVKLGGKDVVYLKQYESSLLSSGEVQKYLKVIADQRFSEEAGQNISDTHLKDKLPDPLTSTNHAHRLQMASNFTSSSFTTIKDVELIVRRRGGDSLVKRHNDWLATVSSAPDVVSMSFVAISSLLNGVPGSGFLSHAVNLYLRYKPPIEELQFFLEFQIPKQWSPGFDLPLGPQRKGPVCPAMQFSLMGPKLYVCTTQVTVGRRPVTGLRLFLEGKKGNRLTIHLQHLSNLPKILQPHWDQHIAIGPPIWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDRGKIALRVKYSLLHY

SEQ ID NO: 1203 - protein, 518 aa, Huperzia phlegmaria
MAERFNEALSISGKVPLGLFNTVFSLNGTWQSDASAIKALAVDCWVISLYNMQISRTPKNLKEEVKKAVPPFWEPAALARFIEKYGTHIIMSVKIGGKDVVYLRQYQSSTLSPGEIKKYLKEIADQRFAEGSGHDISNMQSKEKSSDPLTSTNHAHRLQMANAHTSASFTAKGDVEVIFRRRGGDCTVKHHSDWLDTVPSSPDVVEMTFIPITSLLNEVPGSGFLSHAIKLYLRYKPPIEELQFFLEFQIPRQWSPGFDLPIVPQRKEPVCPSLQFSLMGPKVYVSTNQVTVGRRPVTGLRLFLEGKKGNRLAIHLQHLSNLPKILQLHWDQHIPIGLPVWKEPEEQDSKWFEHVQWKSFSHVSTAPIEYRRESYVGETSAVYIVTGAQLRVWDFGLKNVLFLRLLFLKVPGCSVKRSVWDHTPQASQKSGLFSQFGLSTNFTSAHKAKPAPVVLNSAVFPEGPPAPAQNLKLLKFVDVKEMSKGAQDVPGHWLVTGAKLDVDKGKIALRLKYSLLHY

SEQ ID NO: 1204 - protein, 518 aa, Platycerium bifurcatum
MAERFNDALNISGKVPLGFFNTMFSLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKSSDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRLWSPGFDLPLVPQRKEPVCPSLQFSLMGPKIYVSTNQVTVGRRPVTGLRLFLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDKGKIALRVKYSLLHY

SEQ ID NO: 1205 - protein, 345 aa, Huperzia phlegmaria
MKCCSILLALFCEGEGLVKDILISAPSRAFDTGRQGNEDGHSMVWAGDQEMAQIEPDRMAAQATAREALQALGRGFDVTLDLRLAYCKGPSGSRIIEFDEEANLDLVIPGGVAIIPNVSGDIRCEKGERTHFISDVLSFHQMAERFNEALNISGKVPSGFFNTVFSLNGTWQSDASAIKALAVDCWVISLYNMQISRTPKNLKEEVKKAVPPFWEPAALARFIEKYGTHIIMSVKIGGKDVVYLRQYQSSTLSPGEIKKYLKEIADQRFAEGSGHDISNMQSKEKSSDPLTSANHAHRLQMANTHTSTSFTAKGDVEVIFRRRGGDCTVKHHSDWLDLFLLPLMS

SEQ ID NO: 1206 - protein, 616 aa, Huperzia squarrosa
MGMVWAGDQMAYREAERTIAQSTAIEALQCLGRGFDVTLDLRLAYCKGPSGSRLVELSEETYPEIVLPGGVVIPNVSKDIKCDKGERTHFRSEVLPFHQMSTRFNEALSITGKMPLGLFNTMFNFNGTWQGDASETKALALDGWFITLYNMQITKPELSLNEEVKKAVPSSWEPAALARFIEKYGTHIIVSVKLGGKDVVYLKQYESSLLSSGEVQKYLKGIADQRFSEEAGQNISDTRLKDKLPDPLTSTNHAHRLQMASNFTSSSFTTIKDVEVILRRRGGDSLVKHHNDWLATVSSAPDVVSMSFVAISSLLNGVPGSGFLSHAVNLYLRYKPPIEELQFFLEFQIPKQWSPGFDLPFGPQRKGPVCPAMQFSLMGPKLYVCTTQVTVGRRPVTGLRLFLEGKKGNRLTIHLQHLSNLPKILQPHWDQHIAIGPPIWKEPEEQDSKWFEPVQWKSFSHVSTAPLEYLVESYVGEINATYIVTGAQLRVWDFGIKNVLFLRLLFCRVPGCSIKRSFWDHTPQASQKSNLFSQLGLSSTSSARKAKPVPIVLNSAIFPDDPPQSTQTHKLLKFVDIKEMTKGAQDKPGHWLVTGAKLDVDGGKIALGVKYSLLHY

SEQ ID NO: 1207 - protein, 620 aa, Platycerium bifurcatum
MVWAGDQEMAQTEPDRMAAQAIAREALQALGRGFDVTLDLRLAYCKGPSGSRIIEFDEKSNLDLVIPGGAAIIPNVSGDIRCEKGERTHFRSDVLPFHEMAERFNDALNISGKVPLGFFNTMFSLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGGSGHDISNMQSKEKSSDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRQWSPGFDLPIVPQRKEPVCPSLQFSLMGPKIYVSTNQVTVGRRPVTGLRLFLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGLFSQLGLSTTFSSASKARPAPVVLNSTVFPEGPPVPVQNLKFLKFVDVKEMMKGAQDMPGHWLVTGAKLDVDKGKIALRVKYSLLHY

SEQ ID NO: 1208 - protein, 333 aa, Huperzia nummulariifolia (Blume)
MVWAGHQQMAQKEPGKLAAEVTAREAVQAIGRGFDVTLDLRLAYCKGPSGSRIIEFDEEANLDLVIPGGAAIIPNVSRDIRCEKGERKHFRSDVLPFHQMAERFNDALNISGKVPSGFFNSVFSLNGTWQSDASAIKALAVDCWVISLYNMQISKTPQNLKEEVKKAVPPFWEPAALARFIEKYGTHIIMSVKIGGRDVVYIKQYQSSTLSPEEIKRYLREIADQRFAEGSGQGISNMQSKEKSSDPLTSANHAHRLQMANTHTSTSFTAKGDVEVIFRRRGGDCTVKHHSDWLDTVPSSPDVVEMTFIPITSLLNGVPGSGFLSHAIKLYLR

SEQ ID NO: 1209 - protein, 613 aa, Platycerium bifurcatum
MVWAGHQQMAQKEPGKFVAEVTAREAVQAIGRGFDVTLDLRLAYCKGPAGSRLIELDEEKNVDMVIPGGGFVLQGVSRDIRCDKGERTRFRSEVLSFHHMSERFNQALSIPGKVPLGLFNTMFSLNGTWQSDASATKSLALDGWFISLYNLQLRKASLTLKEEVKEAVPSVWEPAALARFIDKYGTHIIESVKVGGKDVVYTRQYQSSPLTPGDIQKYLKELADQRFAEGSGQNNVNMRAKEKSLDPFAVTNHAHRLQLASTNTSSSFTAKGDVEVNYKRRGGDNLVRFHGDWLATVPLSPDVISMSFVPITSLLNGVPGSGFLSHAINLYLRYKPPIEELRSFLEFQIPRQWCPGFDLPLGPQRKEPACPSLQFSFMGPKLYINTAQVIVGRRPVTGLQLFLEGKKGNRLAIHLQHLSNLPKILQPHWGQHIAVGPPVWKQPEELDTKWFEPVQWKSFSHVSTAPIEYGKEDDNIANIVTGAQLQVWDLGAKKVLFLRLLFSKVPGCSIKTSFWDHTPQSSQKSGLFSQLGLSTNFTSARKAKPAAVILNSAIFPEGPPAAVQKLKLLKFVDVKEMTKGAHDTPGHWLVTGARLDADRGKIALRVKYALLLY

SEQ ID NO: 1210 - protein, 614 aa, Huperzia tetratoides
MVWAGDQEMVQKEPDRMVAQATAREALQALGRGFDVTLDLRLAYCKGPPGSCLIELDEEEKSEILIPGGAAIIPDVSRDIKCDKGERTHFSSEVLPFEQMSERFNQALSISGKVPLGLFNTMFSLNGTWQSDASATKALAVDGWFISLYNMQISKTPQSLKEEVIKAVPPFWEPAALASFIEKYGTHIIMSVKIGGKDVVYIRQYQSSPLSPGEIKRYLKEIADQRFAEGSEQFMSNTRSNEKSPIPLTSTSHAHRLQMANAYTSASFTTKGDVEVILRRRGGDCMVKHHSDWLATVPFSPDVIAMSFIPITSLLNGVPGSGFLSHAISLYLQYKPPIEELQLFLEFQIPRQWSPGFDLPFGCQRKEPVYPSLQFSLMGPKLYVSTAQVTVGRRPVTGLRLCLEGKKGNRLAIHLQHLSNLPKILQPHWDQHIPIGLPVWKEPEEQDSKWFEPVQWKSFSHVSTAPIEYREESYVGETSAVYIVTGAQLRVWDFGLKNVLFLRLLFLKVPGCSVKRTVWDHSPESSQKSSLFPQLGLSTTFSSACKAKPAPVESNSTVFTEGDVKSLKFLKFVDIKEMTKGAQDMPGHWLVTGAKLDVDKGKIALRVKYSLLHY

SEQ ID NO: 1211 - protein, 617 aa, Huperzia squarrosa
MVWAGDQEMVQKEPDRMASQATAREALQALGRGFDVTLDLRLAYCKGPPGSCLIELDEEEKSDILIPGGAAIIPDVSRDIKCDNGERTHFSSEVLPFEQMSERFNQALSISGKMPLGLFNTMYSLNGTWQSDASATKALAVDGWFISLYNMQISKTPQSLKEEVIKAVPPFWEPAALASFIEKYGTHIIMSVKIGGKDVVYIRQYQSSPLSPGEIKRYLKEIADQRFAEGSEQFMSNVRSNEKSPIPLTSTSHAHRLQMANAYTSASFTTKGDVEVILRRRGGDCMVKHHSDWLATVPFSPDVIAMSFIPITALLNGVPGSGFLSHAINLYLRYKPPIEELRLFLEFQIPRQWSPGFDLPFGCQRKEPVYPSLQFSLMGPKLYVSTAQVTVGRRPVTGLRLCLEGKKGNRLAIHLQHLSNLPKILQPHWDQHLPIGLPVWKEPEEQDSKWFEPVQWKSFSHVSTAPIEYRRESYVGETSAVYIVTGAQLRVWDFGLKNVLFLRLLFLKVPGCSVKRSIWDHAPQASQKSGLFSQFGLSTNFTSAHKAKPAPVVLNSAVFPEGPPAPAQNLKLLKFVDVKEMTKGAHDTPGHWLVTGARLDADRGKIALRVKYALLLY

SEQ ID NO: 1212 - protein, 617 aa, Huperzia nummarifolia
MVWAGDQEMAQTEPDRMAAQAIAREALQALGRGFDVTLDLRLAYCKGPPGSCLIELDEEEKSDILIPGGAAIIPDVSRDIKCDKGERTHFSSEVLPFEQMSERFNQALCISGKMPLGLFNSMYNLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKSSDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRQWSPGFDLPIVPQRKEPVCPSLQFSLMGPKIYVSTNQVTVGRRPVTGLRLFLEGKKGNRLAIHLQHLSSLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDRGKIALRVKYSLLHY

SEQ ID NO: 1213 - protein, 570 aa, Huperzia nummulariifolia (Blume)
MRERGIIEFDEEANLDLVIPGGAAIIPNVSRDIRCEKGERKHFRSDVLPFHQMAERFNDALNISGKVPSGFFNSVFSLNGTWQSDASAIKALAVDCWVISLYNMQISKTPQNLKEEVKKAVPPFWEPAALARFIEKYGTHIIMSVKIGGRDVVYIKQYQSSTLSPEEIKRYLREIADQRFAEGSGQGISNMQSKEKSSDPLTSANHAHRLQMANTHTSTSFTAKGDVEVIFRRRGGDCTVKHHSDWLDTVPSSPDVVEMTFIPITSLLNGVPGSGFLSHAIKLYLRYKPPIEELQFFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGLLSQLGLSTTFSSASKAKPAPVVLNSAVFPEGPPVPVQNLKFLKFVDVKEMMKGAQDMPGHWLVTGAKLDVDKGKIALRVKYSLLHY

SEQ ID NO: 1214 - protein, 613 aa, Huperzia nummulariifolia (Blume)
MVWAGDQEMAQTDSDRMAAQATAREALQALGRGFDVTLDLRLAYCKGPSGSRIIEFDEEANLDLVIPGGAAIIPNVSRDIRCEKGERKHFRSDVLPFHQMAERFNDALNISGKVPSGFFNSVFSLNGTWQSDASAIKALAVDCWVISLYNMQISKTPQNLKEEVKKAVPPFWEPAALARFIEKYGTHIIMSVKIGGRDVVYIKQYQSSTLSPEEIKRYLREIADQRFAEGSGQGISNMQSKEKSSDPLTSANHAHRLQMANTHTSTSFTAKGDVEVIFRRRGGDCTVKHHSDWLDTVPSSPDVVEMTFIPITSLLNGVPGSGFLSHAIKLYLRYKPPIEELQFFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEPVQWKSFSHVSTAPIEYGKEDDLIANIVTGAQLQVWDLGAKKVLFLRLLFSKVPGCSIKTSFWDHTPQSSQKSGLFSQLGLSTNFTSARKAKPAAVILNSAIFPEGPPAAVQKLKLLKFVDVKEMSKGAQDVPGHWLVTGAKLDVDKGKIALRLKYSLLHY

SEQ ID NO: 1215 - protein, 613 aa, Huperzia carriata (Philippines)
MGIDWAGDQMAYREAERTIAQSTAIEALQCLGRGFDVTLDLRLAYCKGPSGSLLVELSEETYPEIVLPGGVVITNVSKDIKCDKGERTHFRSEVLTFHQMSTRFNEALSITGKMPLGLFNTMFSFNGTWQGDASETKALALDGWFITLYNMQITKPELSLNEEVKKAVPSSWEPAALARFIEKYGTHIIVSVKLGGKDVVYLKQYESSLLSSGEVQKYLKVIADQRFSEEAGQNISDTHLKVIADQRFSEEAGQNISDTHLKDKLPDPLTSTNHAHRLQMASNFTSSSLTTIKDVEVIVRRRGGDSLVKRHNDWLATVSSAPDVVSMSFVAISSLLNGVPGSGFLSHAVNLYLRYKPPIEELQFFLEFQIPKQWSPGFDLPLGPQRKGPVCPAMQFSLMGPKLYVCTTQVTVGRRPVTGLRLFLEGKKGNRLTIHLQHLSNLPKILQPHWDQHIAIGPPIWKEPEEQDSKWFEPVQWKSFSHVSTAPIEYLQESYIGETSAVYIVTGAQLRVWDFGLKNVLFLRLLFLKVPGCSVKRTVWDHSPESSQKSGLFSQLAVSKTFSSAHKAKPAPVVLNSAVLPEGPHVPVQSLKFLKFVDVKEMIKGAITTIVFS

SEQ ID NO: 1216 - protein, 428 aa, Huperzia nummulariifolia (Blume)
MVWAGDQEMAQTDSDRMAAQATAREALQALGRGFDVTLDLRLAYCKGPPGSCLIELDEEEKSDILIPGGAAIIPDVSRDIKCDKGERTHFSSEVLPFEQMSERFNQALSIPGKVPLGLFNTMFSLNGTWLSDASATKALAVDGWFISLYNMQISKIPLHLKEEVQKAVPPCWEPAALASFIEKYGTHIIMSVKIGGKDVVYIRQYQSSPLSPGEIKRYLKEIAGQRFAEGSEQVMLNMRSNEESPIPLTSHAHRLQMANAYTSASFTTKGDVEVILRRRGGDCMVKHHSDWLATVPFSPDVIAMSFIPITALLNGVPGSGFLSHAIKLYLRYKPPIEELQFFLEFQIPRQWSPGFDLPLVPQRKEPVCPSLQFSLMGPKVYVSTNQVTVGRRPVTGLRLSLEGKKGNRLAIHLQHLSNLPKILQPPLC

SEQ ID NO: 1217 - protein, 348 aa, Huperzia phlegmoides
MVWAGDQEMAQTDSDRMAAQATAREALQALGRGFDVTLDLRLAYCKGPPGSCLIELDEEEKSDILIPGGAAIIPDVSRDIKCDKGERTHFSSEVLPFEQMSERFNQALSVPGKVPLGLFNTMFSLNGTWQSDASATKALAVDGWFISLYNMQISKIPLRLKEEVKKAVPPCWEPAALASFIEKYGTHIIMSVKIGGKDVVYIRQYQSSPLSPGEIKRYLKEIADQRFAEGSEQFMLNMRSNEKSPIPLTSTSHAHRLQMANAYTSTSFTTKGDVEVIFRRRGGDCTVKHHSDWLATVPSSPDVVAMTFIPITSLLNEVPGSGLLSHAINLYLRYKPPIEELQLTLSSI

SEQ ID NO: 1218 - protein, 617 aa, Huperzia nummulariifolia
MVWAGDQEMAQTEPDRMAAQAIAREALQALGRGFDVTLDLRLAYCKGPSGSHIIEFDEEANLDLVIPGGAAIIPNVSGDIRCEKGERTHFRSDVLPFHEMAERFNDALNISGKVPLGFFNTMFSLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKSSDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRQWSPGFDLPLVPQRKEPVCPSLQFSLMGPKIYVSTNQVTVGRRPVTGLRLFLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDKGKIALRLKYSLLHY

SEQ ID NO: 1219 - protein, 615 aa, Huperzia salvinioides
MVWAGDQEMAQTDSDRMAAQATAREALQALGRGFDVTLDLRLAYCKGPSGSRIIEFDEEANLDLVIPGGAAIIPNVSRDIRCEKGERKHFRSDVLPFHQMAERFNEALNISGKVPLGLFNTMFSLNGTWLSDASATKALAVDGWFISLYNMQISKIPLHLKEEVQKAVPPCWEPAALASFIEKYGTHIIMSVKIGGKDVVYIRQYQSSPLSPGEIKRYLKEIAGQRFAEGSEQVMLNMRSNEESPIPLTSHAHRLQMANAYTSASFTTKGDVEVILRRRGGDCMVKHHSDWLATVPFSPDVIAMSFIPITALLNGVPGSGFLSHAIKLYLRYKPPIEELQFFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGLLSQLGLSTTFSSASKAKPAPVVLNSAVFPEGPPVPVQNLKFLKFVDVKEMSKGAQDVPGHWLVTGAKLDVDKGKIALRLKYSLLHY

SEQ ID NO: 1220 - protein, 344 aa, Platycerium bifurcatum
MVCAGDQEMAQTDSDRMAAQATAREALQALGRGFDVTLDLRLAYCKGPSGSRIIEFDEKSNLDLVIPGGAAIIPNVSGDIRCEKGERKHFRSDVLPFHEMAERFNDALNISGKVPLGFFNTMFSLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKSSDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFF

SEQ ID NO: 1221 - protein, 503 aa, Platycerium bifurcatum
MARGNQMHFSLNGTWQSDASATKALAVEGWFISLYNMQISKIPLRLKEEVKKAVPPCWEPAALASFIEKYGTHIITSVKIGGKDVVYIRQYQSSPLSPGEIKSYLKEIADQRFAEGSEQFMLNMRSNEKSPIPLTSTSHAHRLQMANAYTSASFTTKGDVEVILRRRGGDCMVKHHSDWLATVPFSPDVIAMSFIPITALLNGVPGSGFLSHAINLYLRYKPPIEELQFFLEFQIPRQWSPGFDLPIVPQRKEPVCPSLQFSLMGPKIYVSTNQVTVGRRPVTGLRLFLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGLFSQLGLSTTFSSASKARPAPVVLNSTVFPEGPPVPVQNLKFLKFVDVKEMMKGAQDMPGHWLVTGAKLDVDKGKIALRVKYSLLHY

SEQ ID NO: 1222 - protein, 617 aa, Huperzia phlegmaria
MVWAGDQEMVQNEPDRMAAQATAREALQALGRGFDVTLDLRLAYCKGPSGSRIIEFDEEANLDLVIPGGAAIIPNVSRDIRCEKGERKHFRSDVLPFHQMAERFNEALSISGKVPLGLFNTVFSLNGTWQSDASAIKALAVDCWVISLYNMQISRTPKNLKEEVKKAVPPFWEPAALARFIEKYGTHIIMSVKIGGKDVVYLRQYQSSTLSPGEIKKYLKEIADQRFAEGSGHDISNMQSKEKSSDPLTSTNHAHRLQMANAHTSASFTAKGDVEVIFRRRGGDCTVKHHSDWLDTVPSSPDVVEMTFIPITSLLNEVPGSGFLSHAIKLYLRYKPPIEELQFFLEFQIPRQWSPGFDLPIVPQRKEPVCPSLQFSLMGPKVYVSTNQVTVGRRPVTGLRLFLEGKKGNRLAIHLQHLSNLPKILQLHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGLFSQLGLSTTFSSASKAKPAPVVLNSAVFPEGPPVPVQNHKFLKFVDVKEMMKGAQDMPGHWLVTGAKLDVDKGKIALRVKYSLLHY

SEQ ID NO: 1223 - protein, 628 aa, Huperzia phlegmaria
MKERIYHYSSHMGIDWAGDQMAYREAERTIAQSTAIEALQCLGRGFDVTLDLRLAYCKGPSGSLLVELSEETYPEIVLPGGVVITNVSKDIKCDKGERTHFRSEVLTFHQMSTRFNEALSITGKMPLGLFNTMFSFNGTWQGDASETKALALDGWFITLYNMQITKPELSLNEEVKKAVPSSWEPAALARFIEKYGTHIIVSVKLGGKDVVYLKQYESSLLSSAEVQKYLKVTADQRFSEEAGLNISDTHLKDKLPDPLTSTNHAHRVPTASNFTSSSFTTIKDVEVILRRRGGDSLVKRHNDWLATVSSAPDVVSMSFVAISSLLNGVPGSGFLSHAVNLYLRYKPPIEELQFFLEFQIPKQWSPGFDLPLGPQRKGPVCPALQFSLMGPKLYVCTTQVTVGRRPVTGLRLFLEGKKGNRLTIHLQHLSNLPKILQPHWDQHIAIGPPIWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSNTFSSARKAKPAPVVLNSAVLPEGPHVPVQSLKFLKFVDVKEMMKGAQDMPGHWLVTGAKLDVDKGKIALRVKYSLLHY

SEQ ID NO: 1224 - protein, 651 aa, Huperzia nummarifolia
MVWAGDQEMAQTEPDRMAAQAIAREALQALGRGFDVTLDLRLAYCKGPSGSRIIEFDEKSNLDLVIPGGAAIIPNVSGDIRCEKGERKHFRSDVLPFHQMAERFNEALNISGKVPLGFFNTMFSLNGTWQSDASATKALAVDCWVISLYNMQIFKTPKNLKEEVKKAVPPFWEPADGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKSSDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRQWSPGFDLPIVPQRKEPVCPSLQFSLMGPKIYVSTNQVTVGRRPVTGLRLFLEGKKGNRLAIHLQHLSSLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDRGKIALRVKYSLLHY

SEQ ID NO: 1225 - protein, 577 aa, Huperzia tetratoides
MSQGLAYCKGPPGSCLIELDEEEKSEILIPGGAAIIPDVSRDIKCDKGERTHFSSEVLPFEQMSERFNQALSISGKVPLGLFNTMFSLNGTWQSDASATKALAVDGWFISLYNMQISKTPQSLKEEVIKAVPPFWEPAALASFIEKYGTHIIMSVKIGGKDVVYIRQYQSSPLSPGEIKRYLKEIADQRFAEGSEQFMSNTRSNEKSPIPLTSTSHAHRLQMANAYTSASFTTKGDVEVIFRRRGGDCMVKHHSDWLATVPSSPDVIAMTFIPITSLLNEVPGSGFLSHAISLYLQYKPPIEELQFFLEFQISRQWSPGFDLPLVPQRKEPVCPSLQFSLMGPKLYVSTAQVTVGRRPVTGLRLCLEGKKGNRLAIHLQHLSNLPKILQPHWDQHIPIGLPVWKEPEEQDSKWFEPVQWKSFSHVSTAPIEYREESYVGETSAVYIVTGAQLRVWDFGLKNVLFLRLLFLKVPGCSVKRTVWDHSPESSQKSSLFPQLGLSTTFSSACKAKPAPVESNSTVFTEGDVKSLKFLKFVDIKEMTKGAQDMPGHWLVTGAKLDVDKGKIALRVKYSLLHY

SEQ ID NO: 1226 - protein, 616 aa, Huperzia nummulariifolia (Blume)
MVWAGDQEMAQTDSDRMAAQATAREALQALGRGFDVTLDLRLAYCKGPSGSRIIEFDEEANLDLVIPGGAAIIPNVSRDIRCEKGERKHFRSDVLPFHQMAERFNDALNISGKVPSGFFNSVFSLNGTWQSDASAIKALAVDCWVISLYNMQISKTPQNLKEEVKKAVPPFWEPAALARFIEKYGTHIIMSVKIGGRDVVYIKQYQSSTLSPEEIKRYLREIADQRFAEGSGQGISNMQSKEKSSDPLTSANHAHRLQMANTHTSTSFTAKGDVEVIFRRRGGDCTVKHHSDWLDTVPSSPDVVEMTFIPITSLLNGVPGSGFLSHAIKLYLRYKPPIEELQFFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEPVQWKSFSHVSTAPLEYLVESYVGEINSTYIVTGAQLRVWDFGIKNVLFLRLLFCRVPGCSIKRSFWDHTPQTSQKSNLFSQLGLSSISSARKAKPVPIVLNSAVYPDDPPTSTQTNKLLKFVDIKEMTKGAQDKPGHWLVTGAKLDVDGGKIALGVKYSLLHY

SEQ ID NO: 1227 - protein, 665 aa, Huperzia carriata (Philippines)
MGIDWAGDQMAYREAERTIAQSTAIEALQCLGRGFDVTLDLRLAYCKGPSGSLLVELSEETYPEIVLPGGVVITNVSKDIKCDKGERTHFRSEVLTFHQMSTRFNEALSITGKMPLGLFNTMFSFNGTWQGDASETKALALDGWFITLYNMQITKPELSLNEEVKKAVPSSWEPAALARFIEKYGTHIIVSVKLGGKDVVYLKQYESSLLSSGEVQKYLKVIADQRFSEEAGQNISDTHLKDKLPDPLTSTNHAHRLQMASNFTSSSLTTIKDVEVIVRRRGGDSLVKRHNDWLATVSSAPDVVSMSFVAISSLLNGVPGSGFLSHAVNLYLRYKPPIEELQFFLEFQIPKQWSPGFDLPLGPQRKGPVCPAMQFSLMGPKLYVCTTQVTVGRRPVTGLRLFLEGKKGNRLTIHLQHLSNLPKILQPHWDQHIAIGPPIWKEPEEQDSKWFEPVQWKSFSHVSTAPIEYLQESYIGETSAVYIVTGAQLRVWDFGLKNVLFLRLLFLKVPGCSVKRTVWDHSPESSQKSGLFSQLAVSKTFSSAHKAKPAPVVLKKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDKGKIALRVKYSLLHY

SEQ ID NO: 1228 - protein, 431 aa, Huperzia phlegmoides
MVWAGDQEMAQTDSDRMAAQATAREALQALGRGFDVTLDLRLAYCKGPSGSHIIEFDEEANLDLVIPGGAAIIPNVSRDIRCEKGERKHFRSDVLPFHQMAERFNEALNIYGKVPLGLFNTMFSFNGTWQSDASATKALAVDCWVISLYNMQISKTPKNLKEEVKKAVPPFWEPAALARFIEKYGTHIIMSVKIGGKDVVYLRQYQSSTLSPEEIKRYLREIADQRFAEGSGHDISNMQSKDQSSTLSPEEIKRYLREIADQRFAEGSGQGISNMQSKEKSSDPLTSTNHAHRLQMANTHTSASFTAKGDVEVIFRRRGGDCTVKHHSDWLATVPSSPDVVAMTFIPITSLLNEVPGSGLLSHAINLYLRYKPVKHHSDWLATVPSSPDVVAMTFIPITSLLNEVPGSGLLSHAINLYLRYKPPIDDISLL

SEQ ID NO: 1229 - protein, 503 aa, Huperzia nummulariifolia
MPLGLFNTMFSFNGTWQGDASETKALALDGWFITLYNMQITKPELSLNEEVKKAVPSSWEPAALARFIEKYGTHIIVSVKLGGKDVVYLKQYESSLLSSGEVQKYLKVIADQRFSEEAGQNISDTHLKDKLPDPLTSTNHAHRLQMASNFTSSSFTTIKDVELIVRRRGGDSLVKRHNDWLATVSSAPDVVSMSFVAISSLLNGVPGSGFLSHAVNLYLRYKPPIEELQFFLEFQIPKQWSPGFDLPLGPQRKGPVCPAMQFSLMGPKLYVCTTQVTVGRRPVTGLRLFLEGKKGNRLTIHLQHLSNLPKILQPHWDQHIAIGPPIWKEPEEQDSKWFEPVQWKSFSHVSTAPLEYLVESYVGEINSTYIVTGAQLRVWDFGIKNVLFLRLLFCRVPGCSIKRSFWDHTPQASQKSNLFSQLGLSSISSARKAKPVPIVLNSAVFPDDPPQSTQTHKLLKFVDIKEMTKGAQDKPGHWLVTGAKLDVDGGKIALGVKYSLLHY

SEQ ID NO: 1230 - protein, 339 aa, Huperzia nummulariifolia (Blume)
MVWAGDQEMAQTDSDRMAAQATAREALQALGRGFDVTLDLRLAYCKGPPGSCLIELDEEEKSDILIPGGAAIIPDVSRDIKCDKGERTHFSSEVLPFEQMSERFNQALSIPGKVPLGLFNTMFSLNGTWLSDASATKALAVDGWFISLYNMQISKIPLHLKEEVQKAVPPCWEPAALASFIEKYGTHIIMSVKIGGKDVVYIRQYQSSPLSPGEIKRYLKEIAGQRFAEGSEQVMLNMRSNEESPIPLTSHAHRLQMANAYTSASFTTKGDVEVILRRRGGDCMVKHHSDWLATVPFSPDVIAMSFIPITALLNGVPGSGFLSHAIKLYLRYKPPIEEL

SEQ ID NO: 1231 - protein, 617 aa, Huperzia nummarifolia
MVWAGDQEMVQNEPDRMAAQAIAREALQALGRGFDVTLDLRLAYCKGPPGSCLIELDEEEKSDILIPGGAAIIPDVSRDIKCDKGERTHFSSEVLPFEQMSERFNQALCISGKMPLGLFNTMFSFNGTWQGDASETKALALDGWFITLYNMQITKPELSLNEEVKKAVPSSWEPAALARFIEKYGTHIIVSVKLGGKDVVYLKQYESSLLSSGEVQKYLKVIADQRFSEEAGQNISDTHLKDKLPDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRQWSPGFDLPIVPQRKEPVCPSLQFSLMGPKIYVSTNQVTVGRRPVTGLRLFLEGKKGNRLAIHLQHLSSLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDRGKIALRVKYSLLHY

SEQ ID NO: 1232 - protein, 615 aa, Huperzia nummulariifolia (Blume)
MVWAGDQEMAQTDSDRMAAQATAREALQALGRGFDVTLDLRLAYCKGPPGSCLIELDEEEKSDILIPGGAAIIPDVSRDIKCDKGERTHFSSEVLPFEQMSERFNQALSIPGKVPLGLFNTMFSLNGTWLSDASATKALAVDGWFISLYNMQISKIPLHLKEEVQKAVPPCWEPAALASFIEKYGTHIIMSVKIGGKDVVYIRQYQSSPLSPGEIKRYLKEIAGQRFAEGSEQVMLNMRSNEESPIPLTSHAHRLQMANAYTSASFTTKGDVEVILRRRGGDCMVKHHSDWLATVPFSPDVIAMSFIPITALLNGVPGSGFLSHAIKLYLRYKPPIEELQFFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGLLSQLGLSTTFSSASKAKPAPVVLNSAVFPEGPPVPVQNLKFLKFVDVKEMMKGAQDMPGHWLVTGAKLDVDKGKIALRVKYSLLHY

SEQ ID NO: 1233 - protein, 613 aa, Huperzia nummulariifolia
MVWAGHQQMAQKEPGKFVAEVTAREAVQAIGRGFDVTLDLRLAYCKGPAGSRLIELDEEKNVDMVIPGGGFVLQGVSRDIRCDKGERTRFRSEVLSFHHMSERFNQALCISGKMPLGLFNSMYNLNGTWQSDASATKSLALDGWFISLYNLQLRKASLTLKEEVKEAVPSVWEPAALARFIDKYGTHIIESVKVGGKDVVYTRQYQSSPLTPGDIQKYLKELADQRFAEGSGQNNVNMRAKEKSLDPFAVTNHAHRLQLASTNTSSSFTAKGDVEVNYKRRGGDNLVRFHGDWLATVPLSPDVISMSFVPITSLLNGVPGSGFLSHAINLYLRYKPPIEELRSFLEFQIPRQWCPGFDLPLGPQRKEPACPSLQFSFMGPKLYINTAQVIVGRRPVTGLQLFLEGKKGNRLAIHLQHLSNLPKILQPHWGQHIAVGPPVWKQPEELDTKWFEPVQWKSFSHVSTAPIEYGKEDDNIANIVTGAQLQVWDLGAKKVLFLRLLFSKVPGCSIKTSFWDHTPQSSQKSGLFSQLGLSTNFTSARKAKPAAVILNSAIFPEGPPAAVQKLKLLKFVDVKEMTKGAHDTPGHWLVTGARLDADRGKIALRVKYALLLY

SEQ ID NO: 1234 - protein, 617 aa, Huperzia carriata (Solomon Islands)
MVWAGDQEMAQIEPDRMAAQATAREALQALGRGFDVTLDLRLAYCKGPSGSRIIEFDEEANLDLVIPGGAAIIPNVSGDIRCEKGERTHFISDVLPFHQMAERFNDALNISGKVPLGFFNTVFSLNGTWQSDASTTKALAVDGWFMSLYNMQISKTPKNLKEEVKKAVPPFWEPAALARFIEKYGTHIIMSVKIGGKDAVYLRQYQSSTLSPGEIKKYLKEIADQRFAEGSGQGISNMQSKEKSSDPLTSTNHAHRLQMANTHTSASFTAKGDVEVIFRRRGGDCTVKHHSDWLATVPSSPDVMSMTFIPITSLLNDVPGSGFLSHAINLYLRYKPPIEELQFFLEFQIPRQWSPGFDLPIVPQRKEPVCPSLQFSLMGPKVYVSTNQVTVGRRPVTGLRLFLEGKKGNRLAIHLQHLSNLPKILQPHWDQHLPIGLPVWKEPEEQDSKWFEHVQWKSFSHVSTAPIEYRRESYVGETSAVYIVTGAQLRVWDFGLKNVLFLRLLFLKVPGCSVKRSVWDHTPQASQKSGLFSQFGLSTNFTSAHKAKPAPVVLNSAVFPEGPPAPAQNLKLLKFVDVKEMSKGAQDVPGHWLVTGAKLDVDKGKIALRVKYSLLHY

SEQ ID NO: 1235 - protein, 617 aa, Huperzia nummulariifolia
MVWAGDQEMAQTEPDRMAAQAIAREALQALGRGFDVTLDLRLAYCKGPSGSHIIEFDEEANLDLVIPGGAAIIPNVSGDIRCEKGERTHFRSDVLPFHEMAERFNDALNISGKVPLGFFNTMFSLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKSSDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRQWSPGFDLPLVPQRKEPVCPSLQFSLMGPKIYVSTNQVTVGRRPVTGLRLFLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDKGKIALRVKYSLLHY

SEQ ID NO: 1236 - protein, 338 aa, Huperzia nummarifolia
MVWAGDQEMAQTEPDRMAAQAIAREALQALGRGFDVTLDLRLAYCKGPSGSRIIEFDEKSNLDLVIPGGAAIIPNVSGDIRCEKGERKHFRSDVLPFHQMAERFNEALNISGKVPLGFFNTMFSLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKSSDPLTSTNHAHRLQMANTHTSASFTAKGDVEVIFRRRGGDCTVKHHSDWLATVPSSPDVMAMTFIPITSLLNEVPGSGFLSHAITAVLLGISDS

SEQ ID NO: 1237 - protein, 355 aa, Huperzia phlegmoides
MVWAGDQEMAQTDSDRMAAQATAREALQALGRGFDVTLDLRLAYCKGPSGSHIIEFDEEANLDLVIPGGAAIIPNVSRDIRCEKGERKHFRSDVLPFHQMAERFNEALNIYGKVPLGLFNTMFSFNGTWQSDASATKALAVDCWVISLYNMQISKTPKNLKEEVKKAVPPFWEPAALARFIEKYGTHIIMSVKIGGKDVVYLRQYQSSTLSPEEIKRYLREIAASTLSPEEIKRYLREIADQRFAEGSGQGISNMQSKEKSSDPLTSTNHAHRLQMANTHTSASFTAKGDVEVIFRRRGGDCTVKHHSDWLATVPSSPDVVAMTFIPITSLLNEVPGSGLLSHAINLYLRYKPPI

SEQ ID NO: 1238 - protein, 616 aa, Huperzia nummarifolia
MVWAGDQEMAQTEPDRMAAQAIAREALQALGRGFDVTLDLRLAYCKGPSGSRIIEFDEKSNLDLVIPGGAAIIPNVSGDIRCEKGERKHFRSDVLPFHQMAERFNEALNISGKVPLGFFNTMFSLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKSSDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRQWSPGFDLPIVPQRKEPVCPSLQFSLMGPKIYVSTNQVTVGRRPVTGLRLFLEGKKGNRLAIHLQHLSSLPKILQPHWDQHIPIGLPVWKEPEEQDSKWFEPVQWKSFSHVSTAPLEYLVESYVGEINSTYIVTGAQLRVWDFGIKNVLFLRLLFCRVPGCSIKRSFWDHTPQASQKSNLFSQLGLSSISSARKAKPVPIVLNSAVFPDDPPQSTQTHKLLKFVDIKEMTKGAQDKPGHWLVTGAKLDVDGGKIALGVKYSLLHY

SEQ ID NO: 1239 - protein, 616 aa, Huperzia carriata (Philippines)
MGIDWAGDQMAYREAERTIAQSTAIEALQCLGRGFDVTLDLRLAYCKGPSGSLLVELSEETYPEIVLPGGVVITNVSKDIKCDKGERTHFRSEVLTFHQMSTRFNEALSITGKMPLGLFNTMFSFNGTWQGDASETKALALDGWFITLYNMQITKPELSLNEEVKKAVPSSWEPAALARFIEKYGTHIIVSVKLGGKDVVYLKQYESSLLSSGEVQKYLKVIADQRFSEEAGQNISDTHLKDKLPDPLTSTNHAHRLQMASNFTSSSLTTIKDVEVIVRRRGGDSLVKRHNDWLATVSSAPDVVSMSFVAISSLLNGVPGSGFLSHAVNLYLRYKPPIEELQFFLEFQIPKQWSPGFDLPLGPQRKGPVCPAMQFSLMGPKLYVCTTQVTVGRRPVTGLRLFLEGKKGNRLTIHLQHLSNLPKILQPHWDQHIAIGPPIWKEPEEQDSKWFEPVQWKSFSHVSTAPLEYLVESYVGEINSTYIVTGAQLRVWDFGIKNVLFLRLLFCRVPGCSIKRSFWDHTPQASQKSNLFSQLGLSSISSARKAKPVPIVLNSAVFPDDPPQSTQTHKLLKFVDIKEMTKGAQDKPGHWLVTGAKLDVDGGKIALGVKYSLLHY

SEQ ID NO: 1240 - protein, 616 aa, Huperzia salvinioides
MGIDWAGDQMAYREAERTIAQSTAIEALQCLGRGFDVTLDLRLAYCKGPSGSLLVELSEETYPEIVLPGGAVITNVSKDIKCDKGERTHFRSEVLTFHQMSTRFNEALSITGKMPLGLFNTMFSFNGTWQGDASETKALALDGWFITLYNMQITKPELSLNEEVKKAVPSSWEPAALARFIEKYGTHIIVSVKLGGKDVVYLKQYESSLLSSGEVQKYLKVTADQRFSEEAGQNIADTHLKDKLPDPLTSANHAHRLQTASNITSSSFTTIKDVEVILRRRGGDSLVKRHNDWLATVSSAPDVVSMSFVAISSLLNGVPGSGFLSHAVNLYLRYKPPIEELQFFLEFQIPKQWSPGFDLPLGPQRKGPVCPALQFSLMGPKLYVCTTQVTVGRRPVTGLRLFLEGKKANRLTIHLQHLSNLPKILQPHWDQHIAIGPPIWKEPEEQDSKWFEPVQWKSFSHVSTAPLEYLVESYVGEINSTYIVTGAQLRVWDFGIKNVLFLRLLFCRVPGCSIKRSFWDHTPQTSQKSNLFSQLGLSSMSSARKAKPVPIVLNSAVYPDDPPTSTQTNKLLKFVDIKEMTKGAQDKPGHWLVTGAKLDVDGGKIALGVKYSLLHY

SEQ ID NO: 1241 - protein, 399 aa, Huperzia carriata (Philippines)
MAQTDSDRMAAQATAREALQALGRGFDVTLDLRLAYCKGPSGSRIIEFDEEANLDLVVPGGAAIIPNVSGDIRCEKGERTHFISDVLPFHQMAERFNDALNISGKVPLGFFNTVFSLNGTWQSDASTTKALAVDGWFMSLYNMQISKTPQNLKEEVKKAVPPFWEPAALAQSDALATKALAVDGWFMSLYNMQISKTPQNLKEEVKKAVPPFWEPAALARFIEKYGTHIIMSVKIGGKDVVYLRQYQSSTLSPGEIKKYLKEIADQRFAEGSGQGISNMQSKEKSSDPVTSANHAHRLQMANTHTSTSFKAKGDVEVIFRRKGGDCTVKHHSDWLATVPSSPDVMSMTFIPITSLLNEVPGSGFLSHAINLYLRYKPPIEELQLFLEFQIPRQWSPGFD

SEQ ID NO: 1242 - protein, 617 aa, Platycerium bifurcatum
MVWAGDQEMAQTEPDRMAAQAIAREALQALGRGFDVTLDLRLAYCKGPSGSRIIEFDEKSNLDLVIPGGAAIIPNVSGDIRCEKGERKHFRSDVLPFHEMAERFNDALNISGKVPLGFFNTMFSLNGTWQSDASATKALAVDGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKSSDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRLWSPGFDLPLVPQRKEPVCPSLQFSLMGPKIYVSTNQVTVGRRPVTGLRLFLEGKKGNRLAIHLQHLSNLPKILQPHWDQHIPIGLPVWKEPEEQDSKWFEPVQWKSFSHVSTAPIEYLKESYVGETSAVYIVTGAQLRVWDFGLKNVLFLRLLFLKVPGCSVKRTIWDHSPESSQKSGLFSQLAVSKTFSSAHKAKPAPVVLNSAVLPEGPHVPVQSLKFLKFVDVKEMMKGAQDMPGHWLVTGAKLDVDKGKIALRLKYSLLHY

SEQ ID NO: 1243 - protein, 650 aa, Huperzia nummarifolia
MVWAGDQEMVQNEPDRMAAQAIAREALQALGRGFDVTLDLRLAYCKGPSGSRIIEFDEKSNLDLVIPGGAAIIPNVSGDIRCEKGERKHFRSDVLPFHQMAERFNEALNISGKVPLGFFNTMFSLNGTWQSDASATKALAVDCWVISLYNMQIFKTPKNLKEEVKKAVPPFWEPADGWFMSLYNMQISKTPQNLKEEVKKAVPPFWEPAALARFIEKYGTHIIMSVKIGGKDVVYIRQYQSSTLSPGEIKKYLKEIADQRFAEGSGHDISNMQSKEKSSDPLTSTNHAHRLQMANTHTSASFTAKGDVEVIFRRRGGDCTVKHHSDWLATVPSSPDVMAMTFIPITSLLNEVPGSGFLSHAINLYLRYKPPIEELQFFLEFQIPRQWSPGFDLPIVPQRKEPVCPSLQFSLMGPKIYVSTNQVTVGRRPVTGLRLFLEGKKGNRLAIHLQHLSSLPKILQPHWDQHIPIGLPVWKEPEEQDSKWFEPVQWKSFSHVSTAPLEYLVESYVGEINSTYIVTGAQLRVWDFGIKNVLFLRLLFCRVPGCSIKRSFWDHTPQASQKSNLFSQLGLSSISSARKAKPVPIVLNSAVFPDDPPQSTQTHKLLKFVDIKEMTKGAQDKPGHWLVTGAKLDVDGGKIALGVKYSLLHY

SEQ ID NO: 1244 - protein, 620 aa, Huperzia nummarifolia
MGIDWAGDQMAYREAERTIAQSTAIEALQCLGRGFDVTLDLRLAYCKGPSGSLLVELSEETYPEIVLPGGVVITNVSKDIKCDKGERTHFRSEVLTFHQMSTRFNEALSITGKMPLGLFNTMFSFNGTWQGDASETKALALDGWFITLYNMQITKPELSLNEEVKKAVPSSWEPAALARFIEKYGTHIIVSVKLGGKDVVYLKQYESSLLSSGEVQKYLKVIADQRFSEEAGQNISDTHLKDKLPDPLTSTNHAHRLQMASNFTSSSFTTIKDVELIVRRRGGDSLVKRHNDWLATVSSAPDVVSMSFVAISSLLNGVPGSGFLSHAVNLYLRYKPPIEELQFFLEFQIPKQWSPGFDLPLGPQRKGPVCPAMQFSLMGPKLYVCTTQVTVGRRPVTGLRLFLEGKKGNRLTIHLQHLSNLPKILQPHWDQHIAIGPPIWKEPEEQDSKWFEPVQWKSFWKSFSHVSTAPLEYLVESYVGEINSTYIVTGAQLRVWDFGIKNVLFLRLLFCRVPGCSIKRSFWDHTPQASQKSNLFSQLGLSSISSARKAKPVPIVLNSAVFPDDPPQSTQTHKLLKFVDIKEMTKGAQDKPGHWLVTGAKLDVDGGKIALGVKYSLLHY

SEQ ID NO: 1245 - protein, 447 aa, Huperzia carriata (Philippines)
MQISKIPLRLKEEVKKAVPPCWEPAALASFIEKYGTHIITSVKIGGKDVVYIRQYQSSPLSPGEIKRYLTEIADQRFAEGSEQFMSNMRSNEKSPIPLTSTSHAHRLQMANTYTSASFTTKGDVEVIFRRRGGDCTVKHHSDWLATVPSSPDVMSMTFIPITSLLNEVPGSGFLSHAINLYLRYKPPIEELQLFLEFQIPRQWSPGFDLPLVPQRKEPVCPSLQFSLMGPKVYVSTNQVTVGRRPVTGLRLSLEGKKGNRLAIHLQHLSNLPKILQPHWDQHIPIGLPVWKEPEEQDSKWFEPVQWKSFSHVSTAPIEYLQESYIGETSAVYIVTGAQLRVWDFGLKNVLFLRLLFLKVPGCSVKRTVWDHSPESSQKSGLFSQLAVSKTFSSAHKAKPAPVVLNSAVLPEGPHVPVQSLKFLKFVDVKEMIKGAITTIVFSVLFLL

SEQ ID NO: 1246 - protein, 264 aa, Huperzia phlegmoides
MVWAGDQEMAQTDSDRMAAQATAREALQALGRGFDVTLDLRLAYCKGPSGSHIIEFDEEANLDLVIPGGAAIIPNVSGDIRCEKGERTHFISDVLPFHEMAERFNDALNISGKVPLGLFNTMFSFNGTWQSDASATKALAVDCWVISLYNMQISKTPKNLKEEVKKAVPPFWEPAALARFIEKYGTHIIMSVKIGGKDVVYLRQYQSSTLSPEEIKRYLREIADQRFAEGSGQGISNMQSKEKDVEVIFRRRGGDCTVKHHSDW

SEQ ID NO: 1247 - protein, 365 aa, Huperzia carinata
MVWARDQEMAQTDSDRMAAQATAREALQALGRGFDVTLDLRLAYCKGPSGSHLIEFDEEANLDLVIPGGAAIIPNVSRDIRCEKGERKHFRSDVLPFHQMAERFNEALNISGKVPLGLFNTMFSFNGTWQSDASATKALAVDCWVISLYNMQISKTPKNLKEEVKKAVPPFWEPAALARFIEKYGTHIIMSVKIGGRDVVYIKQYQSSTLSPEEIKRYLREIADQRFAEGSGQGISNMQSKEKSSDPVSKEKSSDPLTSTNHAHRLQMANTHTSASFTAKGDVEVIFRRRGGDCTVKHHSDWLATVPSSPDVVEMTFIPITSLLNEVPGSGFLSHAIKLYLRYKPPIEELQFFLEFQIPRVVSRF

SEQ ID NO: 1248 - protein, 617 aa, Huperzia carriata (Solomon Islands)
MVWAGDQEMAQIEPDRMAAQATAREALQALGRGFDVTLDLRLAYCKGPSGSRIIEFDEEANLDLVIPGGAAIIPNVSGDIRCEKGERTHFISDVLPFHQMAERFNDALNISGKVPLGFFNTVFSLNGTWQSDASTTKALAVDGWFMSLYNMQISKTPKNLKEEVKKAVPPFWEPAALARFIEKYGTHIIMSVKIGGKDAVYLRQYQSSTLSPGEIKKYLKEIADQRFAEGSGQGISNMQSKEKSSDPLTSTNHAHRLQMASNFTSSSFTTIKDVELIVRRRGGDSLVKRHNDWLATVSSAPDVVSMSFVAISSLLNGVPGSGFLSHAVNLYLRYKPPIEELQFFLEFQIPKQWSPGFDLPIVPQRKEPVCPSLQFSLMGPKVYVSTNQVTVGRRPVTGLRLFLEGKKGNRLAIHLQHLSNLPKILQPHWDQHLPIGLPVWKEPEEQDSKWFEPVQWKSFSHVSTAPIEYLKESYVGETSAVYIVTGAQLRVWDFGLKNVLFLRLLFLKVPGCSVKRTVWDHSPESSQKSGLFSQLGLSTTFSSASKAKPAPVVLNSAVFPEGPPVPVQNLKFLKFVDVKEMMKGAQDMPGHWLVTGAKLDVDKGKIALRVKYSLLHY

SEQ ID NO: 1249 - DNA, 25 bp, artificial sequence
  cloning primer
gattaccatatggcccaaatagagc

SEQ ID NO: 1250 - DNA, 26 bp, artificial sequence
  cloning primer
gctaactcgagctagtctaaatgacg

SEQ ID NO: 1251 - DNA, 48 bp, Artificial Sequence
  cloning primer
gctgcagggatcgagggaagggaacccaacaaaggtggtgctccagcc

SEQ ID NO: 1252 - DNA, 45 bp, Artificial Sequence
  cloning primer
cgggctttgttagcagccggatctactccaaatggcgtgatttgc

SEQ ID NO: 1253 - DNA, 37 bp, Artificial Sequence
  cloning primer
gctgcagggatcgagggaagggaggactccaaagctc

SEQ ID NO: 1254 - DNA, 44 bp, Artificial Sequence
  cloning primer
cgggctttgttagcagccggattcagacaaactcgacagcatcc

SEQ ID NO: 1255 - DNA, 28 bp, Artificial Sequence
  cloning primer
cagataaccatatggcccaaatagagcc

SEQ ID NO: 1256 - DNA, 30 bp, Artificial Sequence
  cloning primer
gctaagaattcctagtctaaatgacgtgag

SEQ ID NO: 1257 - DNA, 29 bp, Artificial Sequence
  cloning primer
aacatatggcccgtatcgagccattacct

SEQ ID NO: 1258 - DNA, 38 bp, Artificial Sequence
  cloning primer
aactcgagctagtctaaatgaggtgagaaacgaacgaa

SEQ ID NO: 1259 - DNA, 28 bp, Artificial Sequence
  cloning primer
ctggttcgaatatcagattacgccatgg

SEQ ID NO: 1260 - DNA, 28 bp, Artificial Sequence
  cloning primer
ctgcttgaaacatcagattaggccatgg

SEQ ID NO: 1261 - DNA, 24 bp, Artificial Sequence
  cloning primer
ttctgaacatcagtagtagtagta

SEQ ID NO: 1262 - DNA, 26 bp, Artificial Sequence
  cloning primer
tgctgctgcaaactaattacagctag

SEQ ID NO: 1263 - DNA, 28 bp, Artificial Sequence
  cloning primer
gcccgttctagttctaatataaatattc

SEQ ID NO: 1264 - DNA, 23 bp, Artificial Sequence
  cloning primer
atggaacccaacaaaggtggtgc

SEQ ID NO: 1265 - DNA, 23 bp, Artificial Sequence
  cloning primer
ctactccaaatggcgtgatttgc

SEQ ID NO: 1266 - DNA, 25 bp, Artificial Sequence
  cloning primer
catcaagcaatcaagctctcaatgg

SEQ ID NO: 1267 - DNA, 24 bp, Artificial Sequence
  cloning primer
tgatcgccttatcacgcattctac

SEQ ID NO: 1268 - DNA, 68 bp, Artificial Sequence
  cloning primer
gccaaagaagctgccgcaaaggcggctgcagggatcgagggaaggatggcccaaatagagccattacc

SEQ ID NO: 1269 - DNA, 68 bp, Artificial Sequence
  cloning primer
gccaaagaagctgccgcaaaggcggctgcagggatcgagggaaggatggcccaaatcaagccactacc

SEQ ID NO: 1270 - DNA, 68 bp, Artificial Sequence
  cloning primer
gccaaagaagctgccgcaaaggcggctgcagggatcgagggaaggatggtgaatatcgagccattacc

SEQ ID NO: 1271 - DNA, 54 bp, Artificial Sequence
  cloning primer
aagcttgtcgacggagctcgaattcggatccctagtctaaatgacgtgagaaac

SEQ ID NO: 1272 - DNA, 67 bp, Artificial Sequence
  cloning primer
gccaaagaagctgccgcaaaggcggctgcagggatcgagggaaggatggaacccaacaaaggtggtg

SEQ ID NO: 1273 - DNA, 68 bp, Artificial Sequence
  cloning primer
gccaaagaagctgccgcaaaggcggctgcagggatcgagggaaggatggaacccaagacaggtggtgc

SEQ ID NO: 1274 - DNA, 54 bp, Artificial Sequence
  cloning primer
aagcttgtcgacggagctcgaattcggatccctactccaaatggcgtgatttgc

SEQ ID NO: 1275 - DNA, 1458 bp, Artificial Sequence
  encodes IPD079Ea/IPD079Aa chimera
atggaacccaacaaaggtggtgctccagccatgaaaaatgtagccaaaccttccacaaagagactcataccgtcatccattgctgcatcatcgcaaacatctgcaaatgcattaaccgagccattgcctggctctgatgccatcggccagagctacgatgcattcgggttcttcgccaatcccagaagcatcatgaaggagttgttcgagttcagtcctcaagaggagatagtcgtggaaggaaatacctggcttctctcttcggacttcgtttacaccgcaattagagacactgagacctccacggtctcacgtcgcaccaaggacgactactccaaggaattggctgtgaaggtgaagctgtctggaagctatggctatttttctgcctccgttgagtctgatttctctcagagcatttccgatgcgacggacaccacatacacttcagttcgcacccacgtcaacaagtggaggctgagcctgaaggacgatgttggggcccttcgctcgaagctgctgcctggcgtcaagcaggcgctggctaccatggatgctacgcagctctttgacacgttcgggactcactatgtgagcgaggtgcttgtgggtgggcgtgcagactacgttgccaccaccaagaccagcgcgttcagctcatccaccagcatcagcgtagcggcagaagcatcattccagtccatcgcgggtggggaggtgtctccggagtccaaggtgcttgcggagatgctgagagagaacagcagcacacgcctgtacgctcttggcgggagtgccctccccaacatcacagatccagccacgtacaacgcctggctggagtccattgacaccatccctgtcttctgcggattcactcaaaacagcctcaagtccatctcggagcttgctgactccgctcaacgccgggacgctctggccaaagcctcccaaagctatatcccatcatacgtgactcgtcctgcagtggttggcttggaggtcataatatcggacagcaactcggagagccctccctatggctacaccagaatagactatgatctgaaccgcaatgccaagggcaaatatatctttttgtgctacaatcaacagaagatatcagtagcaggatcccctgcggatccgacgcccatcactgccttgtacgtggcttctggcgatgacgatcatccatacgttcctctaggttataccaggatcaacagcgatctgaacgagggtgcggggggcaaatatatctatctatgctacacaaaagatccggctgcaatacccagcgacgaggatggactgcccatacgtggcatccgcgttattggtaatgaaaaagtcgagaatgtggttacaccttacggattcacgaagattgataaagatctgaacgagggtgcaggaggagactatatcttcgtttgtttctcacgtcatttagac

SEQ ID NO: 1276 - protein, 486 aa, Artificial Sequence
  IPD079Ea/IPD079Aa chimera
MEPNKGGAPAMKNVAKPSTKRLIPSSIAASSQTSANALTEPLPGSDAIGQSYDAFGFFANPRSIMKELFEFSPQEEIVVEGNTWLLSSDFVYTAIRDTETSTVSRRTKDDYSKELAVKVKLSGSYGYFSASVESDFSQSISDATDTTYTSVRTHVNKWRLSLKDDVGALRSKLLPGVKQALATMDATQLFDTFGTHYVSEVLVGGRADYVATTKTSAFSSSTSISVAAEASFQSIAGGEVSPESKVLAEMLRENSSTRLYALGGSALPNITDPATYNAWLESIDTIPVFCGFTQNSLKSISELADSAQRRDALAKASQSYIPSYVTRPAVVGLEVIISDSNSESPPYGYTRIDYDLNRNAKGKYIFLCYNQQKISVAGSPADPTPITALYVASGDDDHPYVPLGYTRINSDLNEGAGGKYIYLCYTKDPAAIPSDEDGLPIRGIRVIGNEKVENVVTPYGFTKIDKDLNEGAGGDYIFVCFSRHLD

SEQ ID NO: 1277 - protein, 443 aa, Artificial Sequence
  IPD079Aa/IPD079Ea chimera
MAQIEPLPGSDAIGLSYDVFGFYANPKSVNRQLFDFAPQQEITLEDHTWLLSTDIVYIAVRDTDINTVSLRTKDAYSTELAASVKVSGSYGSFSASVESDFSQSISDETDSTYTSVRTHVNKWRLSLKDDVGALRSKLLPGVKQALATMDATQLFDTFGTHYVSEVLVGGRADYVATTKTSAFSSSTSISVAAEASFQSIAGGEVSPESKVLAEMLRENSSTRLYALGGSALPNITDPATYNAWLESIDTIPVFCGFTQNSLKSISELADSAQRRDALAKASQSYIPSYVTRPAVVGLEVIISDSNSESPPYGYTRIDYDLNRNAGGKYVFLCYKQKNISVGGDADAITDVLVVYGNDRNPSVPSGYTKIDKDLNSGAGGKYIYFCYSKDKRKQEEGLPIRGLRVVGPHPTSVAPYGFSKIDIDLNMGAGGDFIYLCKSRHLE

SEQ ID NO: 1278 - protein, 486 aa, Artificial Sequence
  IPD079Aa/IPD079Ea
MEPNKGGAPAMKNVAKPSTKRLIPSSIAASSQTSANALTEPLPGSDAIGQSYDAFGFFANPRSIMKELFEFSPQEEIVVEGNTWLLSSDFVYTAIRDTETSTVSRRTKDDYSKELAVKVKLSGSYGYFSASVESDFSQSISDATDTTYTSVRTHVNKWRLSLKDDVGALRSKLLPGVKQALATMDATQLFDTFGTHYVSEVLVGGRADYVATTKTSAFSSSTSISVAAEASFQSIAGGEVSPESKVLAEMLRENSSTRLYALGGSALPNITDPATYNAWLESIDTIPVFCGFTYESLQPIWELAESPQRQEILQKATKTFIPPEIRRNAIVDVDIIVSDNYWVNPPYGYTKIDYDLNRNAKGKYIFLCYNQQKISVAGSPADPTPITALYVASGDDDHPYVPLGYTRINSDLNEGAGGKYIYLCYTKDPAAIPSDEDGLPIRGIRVIGNEKVENVVTPYGFTKIDKDLNEGAGGDYIFVCFSRHLD

That which is claimed is:

1. A recombinant polynucleotide operably linked to a heterologous regulatory element wherein the recombinant polynucleotide encodes an insecticidal polypeptide comprising an amino acid sequence selected from:

a. an amino acid sequence having at least 95% identity to the amino acid sequence of SEQ ID NO: 2;

b. an amino acid sequence having at least 95% identity to the amino acid sequence of SEQ ID NO: 56; and c. an amino acid sequence having at least 95% identity to the amino acid sequence of SEQ ID NO: 144.

2. The recombinant polynucleotide of claim 1, wherein the coding region for the insecticidal polypeptide is a non-genomic polynucleotide.

3. The recombinant polynucleotide of claim 1, wherein the polynucleotide is a cDNA.

4. The recombinant polynucleotide of claim 1, wherein the polynucleotide is a synthetic polynucleotide.

5. The recombinant polynucleotide of claim 3, wherein the polynucleotide has codons optimized for expression in a maize plant.

6. A DNA construct comprising the polynucleotide of claim 1.

7. A transgenic plant or plant cell comprising the DNA construct of claim 6.

8. A fusion protein comprising the insecticidal polypeptide encoded by the recombinant polynucleotide of claim 1.

9. A method for controlling a Coleopteran pest, comprising contacting the insect pest population with the insecticidal polypeptide encoded by the recombinant polynucleotide of claim 1.

10. A method of inhibiting growth or killing a Coleopteran pest or pest population, comprising contacting the insect pest with a composition comprising the insecticidal polypeptide encoded by the recombinant polynucleotide of claim 1.

* * * * *